United States Patent 10,407,724 (METHODS AND COMPOSITIONS FOR SCREENING AND TREATING DEVELOPMENTAL DISORDERS) - sequence listing, part 25

SEQ ID NO: 617 - DNA, 609168 bp, Homo sapiens
tgtctggcttccttttgtattgagaagtgacattttgcattatgggatgagtaaatcgagcctcaccatagtttggatcagcctatctgaagtaatcagtgtccttatgctacgagtacataaagatgatcagtgcagcccagctattccattgtgcctcaacatgtcattctgttcagagcagagtctctctagaagctcagcctgtctggctgtcactacagctcggcccattgggagatgtacatgaagcatgaacacccacatcttcacccagttgaaatgcatccaaatggaggccattttctaggccaggggttgtcagctccctgggtggcaaaccggtacacatagcaggaggtgagcaggaataaggaagcattcctgcctgaactctgcctcctgtcagattggaggtgggattacattctcataggagcgcgaaccctattgtgaactgtgcatgtgagggacctaggctgtgtgttccttatgagaatcaaatgcctgatgatctgagtgaaatagtttcatcctgaaaccatcctccacccccttcatggaaaaattgtctttcacaaaactggtccctggagccaaaaggttggggaccaatggtctaggtgacatcaaagtgagacagtgggaaccactgtctcagcaacagccctctgacttgtggatgcttccaaagagccttcactttgtgtaaagggtcatcttcccttccctttccccacatggcctctactcctgccctgcaaatcctatctatgatggtccatgacctgggaagatgggagagggaaccccaggagagatccccactatccaactccaaggacgtctgacgtttgtggaacactaagattatgaaagagaaacaacactgcagtgaggaccgctgattctggggcaaataaaaataatgaagtgagaaatgaagaaccttgaacaattctaattccttaagagatgtgagaacatacattaccataaaataggtagaggttgcaatgaggaaggactcatcagagactaagaaacaactcttggaaattaaaataaggctgtcaggtaactacccatgaagctgaattccacactagtcagctggaaaaaaaaattttttttaaagtacagaaaatttcacagaatacaaaataaaaaggcaaacagataatatgaaacaaacggtaagagaaatggaggctagacccagatggtccaataaatatctaatacaggtgtttgaaggacagacctgtggcagctgaagagcctttcttctccaataattaaaacataagtcctgggattcagtctcactggactaacttgaattgtaaccctatccttgaagcaattactgtaccagaaatatggagaaaacatgaaagtgatatattgattttcaaatgttaagatggcttaaagacagaacaaatacgtaaaaatttatggatctgaatgcaaatgttatcagtcttgcctatgtaaatataaagttgcagtttacataagatgagaaaaagaactacataagatatgtgtagagaataggttcctaaaattgaagcttcaagtgatgcttaaaattgtcaaaaacagaaaaccatttatgtaccttatttaaaggtactataatattaactgaagaactaaaataactttccttaatttaagaagagggactgtcaagctaaatccctcctcttatgtagaagagaatcaacagttagtacctaaagctgataaactgaagaagtatgttatttacaattacagtagggaacaccagcagaatttaaaagagaaattattacaagttctctctggagagttggatttggtttcaaaatggattgaggggattctattagcttttatttcatacccttctctatttttaaaaaaacaatttgcatgtagtcagccctctgtatctgtgggctccacatccatggattcaaccaaccgtggacagaaaatattcagagggaaaaaaattgaatctgtaccgaatatgtacagatgtttttccttcttgttatttcctaaacgacacagcataacaactatttatgtagcatttacattgtattaggtattataagtaatctagaaataaagtataaaaagggtgtgcatgggttatatgcaaatattacaccattttctatatcagggacttgagcatcccaggattttggtgtccctaggtgtcctggaaccagtcctccatggatacctagggacaattgtattattttgtgatacaaatgtgtgcataaatacatgagtaaaatatgtaattataaagctagaaaactttagattatcttagaatagtatctgtaaacatttaaatgatattactatgtatatacataaaacattgcgtgagcttgggaaatatacatatttttgcacttgtaagaactgttaagaggtggaaaatatttttctattctagcagttgacagtttctttctgtaaagggccagacagtaaatatttagggcttcgtgatcataaggaacaattcagggcattatgtatgtacatatataaccagggaaaaaaatcccacaatttgtattgtcaaaatttagaatatgataaaaattgactatgattttgtcataatacaaatttactaatgagaagaacaaaaaccttttttgaggggaaaggtgataatattttgtttagttgcggttcaaagtgagtgttctctcttgtcaacccagttttaacattcatctgtaaagacagactcatttgtgggccgtaaaaaaaaacacacgtgctggaccggattttgttcatgggctacatgtagttcgccgactgccgctctatttagtctgctcccatttagctggaatccagacttaggatttctcagctctctgttgtgaatcgccaggtttcttctcagtttgttgcagaatcaatactctgttaaacaaaataaaaactgagttactataaaaatgaaatttaaaaaaaaagcagacatacaaaatatagcccccaacatttaattattagaattaataaacaaaattatcctgctaaattactacaaaagtttctgaacacttacattttcaatttccatatttatatagtggcaaaaagataataaagagctttgcagcctgatcccaaatagttccttcatctttttggacttttaaaaaatatattttctaactgcattgtagtataatttctaacatatatggcattgccaaaacttggaatgtgcttttctgcatcattagtgacttctgacttctccgattggaacacacgtatgtttgtttcctttgcaggcctaattggcaagactgcagataccctagaggaattgaggaaaggtggataaagcaactgattgctttttttcaggaccctttagtctatttcctttgtgaattcgttcatttggaggacaaccttagaatgagcattagttaccagattgagccatcaactatcttccgagagacaaactataatttcctgaatttattacccaatattttataccacttgtcttgcagtattttgctgttataagatgcatttattactgatgatttccatctactaaggcgtaagtcaaaccagcattccattttgtcactcttctgcatttcatatttagccaacttagagttcgatggaatagaaatacgctctatcgaaattactcaattactgtattcaaaagtttccacaaatgctgtaggtactaagagaatatttatgtaaattcacattttccaaccatgctcatctatgttagtttaaaatgcaagagttaaatttttcattttgtggtgatactattcccaagtgcattatgttcattgctttgaagaagcatctattacatcttaaaacacacttgccatcattttctttctttgtaagaatgaaaacactttagagctacagcagactcttaattaacttaagaaaaagatgaaaaaaaaagccttgcttcctttctctgtctctgtcaggctgcaggaggactacattcttgagtaggaaatgaaagatttacgacatttttgagactacaatttttaatgagatgcacattccttttctcatgtaagccttgtctcagggggtctcggagcagagagggaagggtttttttgtctgcgtctcctgatggtcctcactggatacgttttgtggagtgttcttctgtttaagaattattttctttcatatcgttttccccattaaacacatatcttatggcatatttgttttgtgccatacaaaggaaacgaaaacgctaagtcctgtttatagcaaccgtttacctgagtatctggaatctatacagtgcacgattttctccaaattacttgtatgtttctattctttaaaataaagaataaggtaattataaaacagtattctgatgtgtaacttccaagatcctaatttctctcatacatattgctactaatggcctgacaaaaaagaaaatatacttcatatacttttctttacttcagtcgcattaaacctaaactgtgtaaaattgatccttcttgaatacagagttggagctcaaccattgttgtatgttctcatgtcactgttagaaaaacaaaaaggtgcttttaagatcaaagaacaacacaaacccagaatacacagtcatggtttgaaaacatagttttagaaatgcacattttgatcttaaaagatcaatgaaggaaagggtttgtgtactagactctgccacaaatgagtacctatattttgcatgtgacatgctgaatgtaatcatatcaacactagtgaatgaatatcagggtatgccacaaacaacagctcattctgattaactggctcatatgctgttttcagtcttcctcttgggagaaaagtatctcatatcaacaaagttgatgtttctacaactaatgtaattccaagctactctacatagcctaacatagagcaaccatgaggttttaaagcatttttcttatagaatattaggactcacaaatacacttctaaatctgcttcaaaataccttgagttcttatcaacactgacactaagttatcccaggtatccatattataaataagcagataagaataatttcatatttttgcaataaaaggatgctatgtagctcatactgcataaaattttcaaaaatataaatttttggctccacggccttcatttcaagcatcttctaaatgtgtgccatttctgcaatcagggagatggcggctggacagcaatctgaaggtgctgattagaggtgttcagggatgaacccaatcaaaacagttaagggcaggaacctgccagttccagggagtttcacactgaatggaaaatactgagtaatcagaatttcaagcagtggccaatgacacagaaaactcataaacattctaaaataaaaatgttgcaggaatgccacctaaagttttaaaaatctttaacaataataataatagttaacatagatgaagtgcttactatgtgcgagggactcttctaaacatttttacatcatttgattcttacagcatttctgtaagtatattattatccccattttaaaatggggaaataaaaacacaaagaagtcaatatcttgcccaagattacacagcacagaaattctgtaaataagattttaactctgatagtttggtctagagcctgggctcttaaccactaggtataatggtaagcaaacattggtgaaaaaaaagtccttatctaaaactatgaaaattaatgttaacatcatcaccaccaccatcatttaaatattggatatgcttgggtttaaagcacaatttagttctgctacttaggagctccatcgttaacatgtttcttaacctctgtaaaatggtacaatagctgtctttcagggttactgcgagattgttatgaatgtatgtaaaccaccgacacaacctcctggcacatcgcagttgctccaaaaggggtatttttattataagtatgataacggaagtgatacatgcatgctgcttacattaactgcttaccagatgattaagcagatatgtctgaatatgaatacaaaatataaatcccacaccagcaaacgtctcaataaaacatttcaaaaaatgtattgggtcatgaaaatgaacttcctagatgtagtgttttacggttgtgtatcacatacgtataacttagggcataaggagaagtctcggcccagacttcacagcctcagttttgaaaaaagggtgtccatggtaggtgtttgatacgtgcttggggctgatgtttatgctgagtttcaatgatcattctcccacattaacgggtttggctgaaaatatcaatatgcaagtagcagatgtgtatagcaactcaaaatgtttatatagcatgaaactcatctatgcaagacagagactttgctggtatactctccaaagcttgaaagtagaggccatttagccgtaaggcaacggtcccaatctgctggtccctaacaccaccccttaagggttcccccaacctacagtcgcaccaagtactatttgcaaactaatcacaagctgctattctgattaatagactacaaattaactcggatggattgttaaggtcatagtagcatgtgtgtgtgtgtgtgtgtgtgtgtacagaagattttctttctctggggtaaatgcccaagaatgtgactgccgagtcatagggtaagtgcatttttaaagatttaaaatgaaatatacttgatttttagagcagttttagagcaagtgaagaaagtgcatatataccctctccctccacacatgcacagcttcccccactaccaacgtcctgaaccagagcagaacatgttagaatccacgaacctacttggacacaccattattccccaaagtgtctgtggtatacattaaggttcgctcttggtgttgtatattctacaggttttgacaaatgtataaagatacatactcaccattttagtaccatccagcaattttcattgccctaaacatctactgtgttctgtctcctcatccctcccttctaccccaattcatggcactcactgatctttttctgcctttttcagaagatcatatagttgcaatcacacagtatgtagccttttcagagtggcttctttcactaaataatatttatttcaggatcctccatgtttgtcttccttgatagttcagttccctttgttgaggaatatgagtccattgtccaaagtggcacagtttttttatatagtcacctgctgaggggcatcttgcttgcttccaagtttgggcaattatgaataaagctgctgtaagcatcacgttttggtttttgtgtggatgtaagttttaacgcatttggttaactatcaaagagtgcaattgctgaatcctatgataagaggatgtttaatttttaaagaaactgccaaactgtcttccaaagtgggcgtagcatgttgccttcccaccagcaatgaatgcgaattcctgttgctcctcagcagcatctggtgttcatattgtagactttggccatcttaataagtgtgtagtgatatttcattgctgtttgaccacagtagcttttcatcatgatatagtatctcagtaaaaacacagaaaaagtataattactttatcataaggggaaactcaaaattttgttggaaagagggactctcatattcaaagaggtaagggatcactaagtaaaaggatcctgatgagaaaattgtacatttcaaagtacttgtgcaaaaatgtccccttttactttctggccacacaccattcctttacctgaaactctggtgcagcctcccagttcatgctgtgcctcctatttcttcccaattttatattccctcaaagcacataagggaaaatttctctttctctttctcaagagaaattctctaaaactgtgctccatgagatcctggtattatgcaagatgtcgttaaaggctctatgaaacaaagttccatctgtttaatataactcgttacacttctccttctctccatgcatggagatacacaatatttaatggcccattaaagggtttgagaagtattagaattaaaacaattaataaagtagcattccaaactatattcacatgtcaggggccccatgggtaggcggtggaggagagagattcagcagaattttttttcaggcagcaccataattacctagaaaacatcatgattagaagaagtcatgtgtctaagactgtcctttctgaaacaagggagcaatttctactttaaagatttttaaagggtgagagtggctgggcacagtggctcaggcttttaatcccaacactttgggaggctgaagtgagcagatcacctgaggtcaggagttcaagaccagcttggtcaacatggtgaaaccccctctctacaaaaaatacaaaaattagccaggcgtggtggcaggcacctgtaatccccgctgctcgggaggctgaggtgggacaatcacttgaacctgggaggcagaggttgcagtgagctgagatcacaccattgtactccagcctgggtgataaagcaagactccatctcaaaataaataaaattaaaaataaataaataattaaaactgtgagagaaaatatagtggagatatggataaagaagtcagaggagtatgcagcacatcacccttccttagaccatcagtaaaagtctgcaagatgaggaaagtggatggtactggatttcctatataaaacagtgacggacggaccagcacacaaggtggccacatggacaagggatagtctgcatggacaaggcacagaaggccgttgtgggccctggactcctgtcaatgagatcactcagctctccctaccagccagaattctgcccactcgagttaacccaagaagctcaactccagatacctgaaaccctttagaacatcatatgataagatgtaaacagtgtaccctctcatttctgatggcttaaactaactatgcattcattaggtataactataaattcattagctttttccacttaaacctggccaggccacatggaatctttgatcttgagccatacttttctccagacagagactgataaatgactttttctggtagttagaactgaatctttattcattgtttcagtatcttcactcttttatgctcctttataaaatactataagaaaaatagacatcttcattaaatagaattctttaaaaattgcctttcatggtatttgctaaattttatttgcttataatagatgatgctcaacacaaggccagctgttgatggtgtgttattacgtaaaacttgtaaacaaggaagcaaggaagtaaactgtttggtccataggcatgggtccacagaatatctaccccagaatcaacacaagtgggttctcaacatgctgattcctaaggctgccctggacctattaatcctgaggacctgggacgtggccaagcaatctgaaagttaatggtctctgaaccactgggttggatcttcatagacagcaaacctggcccaaagaattactcagagtacaaagagaacacaaaaggatgaagaaaaagtagttggaattttgcaatttaggggctgtaaggggccttaaaagatcatctagctcaaccctatgtctttatagtagagaaaaatatgttatttaacccagatcaccaagttgaatcagttgacattctttcccatctaaaatgtcgttagtctagaaattgaagaaatgaagaaaatctgaaagaatggaaaaggaaagaaacatatatctggaagaagtcaactaaccagtttcagagaaatgttctaattgttcaagatgtactcaacttgaatctgtgatcttttctaaagacatttttttaaccttaagatttgcttttcagtattagtattgcttgagacaatagaagctaaatatttgtggaaatctacatcatgaacaggtactcgcttgggcagcaaattacagagtaagtaatcattttctaatttcaaggttcctattcttttagtcatttaaaattcagacttcaagccaatctatgaatgccaggtttctgttaattacaaacaattcatcttaattagcctgaaagatggttctaacaagaaataaattattgagcacaaaaagcaagttttatgacatgtttaatgttcatttcaaatccctttcaaaacaaatagcagtggagaacgtggagggttagaaagataacttttgttgctggattgatttcaaatcttccctggctgcttgcaggtgtagcactgttcacttgaaaatttattgtaacagatcacaatcattacaatcatgatggtaatcaatgttcattaaagatacaatgaaaattccatgattaaaggccatttgtttcatcacaataagatcatttatttattattgggtaaattgttacaaattgcatatgtttggggcagttgaaacagggaacatgaatttggggattgaggccgtgagtgccttttacttggtgaaattctgacaattcaaagagaagactgcatgtggcccgtgaaagaaagacaggctgtgcttttactcaccacaattctacactgtgatctgatggtcattattcctcccaactcggctcttcatttttctaaattagacaatgctgaacatatcctggtgcctttgcgctgtgttataaatggttttaagcagcatggaagttgcactgttctttatttaattccatcagcactcttagctagtctactatgtaaaaagagagttgaagacattatatgggcttcttctctttatttttgttttcgttttaaaaccaaagcaaacatctcagatcaattcaaaaggaatgagcaggaaaccctcaccaagatggaaagtgctaacatttcacatgaaaagaagttttttccctgaattatgctccctgtttaaccatctaactcagattaacactatcttacttgacagccaccagcaagattcacctacccctgccattcaaattccaaacagtcagtacaaacaaattttttttaaagacgaattcaactgttctagtgtaaagctgttttgggctcatctgcaggccaaacacattggctcagagaaacctgtttgctgtcagacaaaggctgttgctgtcattaagagttgttcttagagggtggccaatcagacacggtgagtcaggtggtcccaaggaaagagaaagaaaatgccacccacccactctgcgaaggctccactggaaaggttccatatgatctggctgtcattgcccttgaattagggctacgggaacaatttgccttacgattcactgagcaggaaagggtcctcgtgttcccttgtgtacagagggtgcacatttccctaaactctcctacttggaagatggacaattgccgaggaatactaaatatggccagcaaattttgtccccaagaaatctgagtgatctctgaggtcaggcaagaatgtgatagcaatttagaattgggcggggtagacaattaaaattagtcatgaggaaacatgcaaaaaacttttgccttctctgacttccgatcccacgaagctgacttcatgttgctaaatattccgattacaagtgaaaaactcagacatatgaaaattctgtttatgagaaccaaaatctacaaagaacacatttttccccaagacactaaatttatgaggtctcaagtttattagtcagtccttagttcctatttgaggttcctattttgagccctcaacaagagctaagaggttatgccttgattaagaatcaatcagaactggagttttactcaatgatatacttaactccttacttaacctgacttagcacaattaattatataagccacaatttcctactccttaaaatgaaagaaatagtaatatctgtgccatggaaatagtaatagaattaaatgatacgatgtatggacacatcctatatggcacatgcttaacaatcaatgaaagctacttacaacaacaacaaacaaacaaacaaacaaacaaaaaacctagggccaggcacagtgactcacacctgtaattcaagcactttggaaggccaagatagaaggattgctggaggccagggtttccgtgagctacgatcgcactgctacactccaaagatctctttttagcctaggagttaataattaatttcatcattatttattgttctatttgatgtaaccacatacagaaactggaaaacagaaaaaagaagattttcttagacacacagaccgatggaacagaaaagagaactcagaaataagactgcacacctacaaccatctgatcttcgacaaacctgacaaaaaaaaaaagcaatgggaaaagggctccctatataataaatggtgctgggagagctggctagccatatgcagaaaattgaaactggaacccttccttacgacatacacaaaaattaactcaagatgaattaaagacttaaatgtaaaacccaaaacaataaaaaccctagaataaaatctaggcaataccattcaggacatagaggtatggggaaagatttcatgaagaaaataccaaaagcaattgcaacaaaagcaaaaattgacaaatgggatctaattaaactaaaaagcttctgcacagcaaaagaaactgtcatcagagtgaagagacaacctacagaatgggagaaaattttttgcaatctatccatctgacaaaggtctaatatcaagagtctacaaggaacttaacaaatttacaagaaaaaaataaatatccccattaaaaagtgggcaaaggacatgaacagtcacttctcaatagaagacatacatgtggccaacaaacatgaaaaaaagctcaacatcactgatcatcaaggaaaaaccacgatgagataacatctcacgcccgtcagaatgagtggcattattattaaaaagtcaaaaaacaacagattctggcaaggttgtggagaaaaagggatgcttttacactgtaaatgggagtgcaaatatttcaaccattgtggaagacagtgtggcaattcctcaaagacctggaggtggaaataccatttgactcagcaatcctactactggatatatactcaaagggatataaatcattctattataaagatacatgcacatgtatgttcactgcagcactattcacaatagcaaagacgtggaatcaacctaaatgtccatcagtgatagacaagataaagaaaatatggcacacatacaccatggaatactatgcagccatacaaaggaatgagattatgtcctttgcagggacatggatggagttggaagcagtatcctcagcaaactaatgcaggaacagaaaaccaaacaccacatgcaatcattcataagtgggaggtgaatgatgagaacacatggacacatgggggaaggacacacactggggcctgtggaggggtgcagggagagggagagcatcaggaagaatagatagtggatgctgggcttaatatctaggagatgggatgatctgggcagcaaaccaccatgacacatgtttacccatgtaacaaacctgcacatcctacacatgtacccctgaacttaaaataaaagttgaagaaaaaaaaaagagatgctcccaattgcaagatcctaacaacttctgttagcattttggtataattttcccagcattttttcctggctgcatttttttacattctctctctcgcatatgtgtgtgtgtgtgtgtatatatatatatatatatatatgtatatatatatgtgtgtgtatatatatatgtatatatatataaaacctatatatagtccatatatagagatatatatgagctgtctttccaacatttcttatagctttaatcatgaagtaaatcaatgtcataataaattttggccctaattatctgccattgtttatttgccttttttcaaagtcaattagaaaaagagagaacattattaagtatttattaagttaaagctccttaatattaaaaagattaatataggagaagatatgaggatctaagcctaaaccttaactggcatgaaaaaaaaatgactttatccgatgctactttgtttcatttaacacagtacactcatgtaggatgttctcttctttccctctcaacagaggcatgtggcactctaagctccacattgctgagttatctttaacttaggtttttctacgagaagaaatatgtgactgcatgcaatacaagtacctgcagagatttagtttagccttgggacaaaaattcataatggctaatttaaagcacaaaggtgacgccaccttgctggaatgaatttagagttgtaacagttgtaaagcatcagtcctgtagtctggatactcggggttgttgctactttctgtttgatttggactcaccatgatgtaactctggcaccactgagaccacgcctggaaaatgcatattcatttgatgccatatataatcaaccaaatatacattgtgtccttattttgatctagtcaccagtgatacaacaataaacaggaccagtctctgacctcaaagaattcatctagtcattctactgagctgatgtgtgccaagattgagttacaatcagcctagaacagtagcaaccatagacacttccagggtgtcaggctgattccccatcttctaaaatgcagtacatttcttgaataaattggccacccaaggcagacatgtgcctcttcactcatctaattcagttcatccatccatgactttagaattgttcaaaaattgcccagcttcctaataccaacaaatattgatacttccctgttttattttagatcacatggtatcttttccctaaatgtattaggtatatttgttaaatagcagactaccaatctggggagcaactgaaatcagaaacatagtgaaagtacccaagatgtatatatgggaataataatattggtgattactacaaggaattcttgtgagaattgaatggaaaattatatacatatatatatttatatatgtaatttttaacttaatcttggcccacatcacatagaaatagtagtagcagatattgtcttcatcatcatcaagataataaaaccatttcagcccctttggaaaataatttggcatttccgcaaaatgttgtgcataaacctaccatatcaccaagcaattccactcctaagtatctgtccaagagaaaagaaacatctatctacataaagacttgcacatcattgtttataacagcattattcataaaagccaggacctgaaaacaacttgaccacccctcagttggcgaatggataaaaatatggtctattcatatgatgaaatagcattggataataaaaaggaatgaactgctggcacatgctacatcatggatgaacctcaaaaacattgccctaagtgaaagaagccagtcacaaaagaccacagactgtggattccatttttaatgatcaatactagattagtagttgcctggggattaaagtgtgaaaaagaattaactgtaaataggcagtagggattttagatggggcatgaaaaaatgctccgagatcgatttatggtgatattcctatcatgccacagagttacaaaacagtcattgaattgtatacctgcaatggctgaactcttatgatatgcaaaacagacctcaataaagttcttacaaggaagataacagaaccaagttctaagtacaccaattatccagttgcctcctttgtatctttcatatatttagagaatctatgtccactaaaatcgcatttatccagttaaagatgagattaagaaattgtgttttcctgttgatagcctgaaccttaacagtataggtaatataggacttaacgtgatttttagattcggaatgatatattcatttgtgaaccgttttctggatcacataaaactttattccaaacataaactgtagcacaaatgacacagtccttcttcacacagatacacacacacacacacacacacacacagccatcagtacgagcagaatggggcataacctttcattcctcacataacatctccacatgatcctcctgccccattaagaagacggcccaaaccaagtacctcaaatccagtgtcccaagaactgtttttagtgtttgaggttgtgtacctgtctttacttgttcccaaattattctaattctaatcctttcaggtctcattttgatcttcccagctctgatctcccaactctgtgaccccaagcttgatcactaactatagatttatggctttgaattgatctctctctctctctctctgcacagtttgtctcctgtgtgtctgtctctgggagaaaccctctgctctagccatgtgaaaacaaattctgaaccaggccttctgactctgtcctcatccctccctcaccatctcctaaacccttcgaagaggaagccatctttttcttttccacatacagagccttttatctgtacatctattatgaaatttaatactttctactatatattaaatatagttatttatgtagttgttgtaacctcaattgtttcatctttacttaatatctttcaaagcatggaatacagagctttgctctcaagaaagtatattttccgaagtgtcccgatagattgaaatatctgttaagtttaagtgaaagggttggttctgctacagtttatttcagttatcagtatagcacgcactgatgcctgagttactgctggaaaatactaccttcctgtcttcttaaggcattgcaaaaggtatggggaaagatcctgaatttgccccaatttttaaacaaaccagagaaacagtaaagcatttaaatgacttattaatgttaacctatttatatctacatatttgttagcctgtgagtaaatggaacttcggatctttgcaaaagaactgccgggttgtaaaaaggattggaaagtcaggctcacttagtagtgtgcagagaaacagactctatgcctggagcaaaaaatcccagcatcccctccacctctacggtgtgatttcttaatgctgtacttggctcgacaaaggaagtctgatatttcagaggtgagttgcaaagtggccaaaccactctttaatgcactatagcttgacataatatttgctgccagcttctcgtttaaaaatgccatcagtttaacattaactgaaaaagtaattattctccagtttcacggagctattaagaaaaaaaaagttcattgaaactccaggaaatgaaatactgtgctttcaggacctattggaagcctttcaacattcagagcagaaaaacataaatttattttttaagaagcagatttaggaactttagtgaatgggaacagaaagcattaacttaagcctcaggggagataacgattcaacaaaattctgaaaaccctccttagatcaaactctcacatattctgaaaactcagtaccatttattgttacaagatccttgatgatttagaaacatgtacccacacatgttaagtcctctgtactaaatcaaagaaacttcaaattagcttgaactttgaaatgctgtaagttacatgaatgatgattcatttctttatattcagtcaccaaatgttattgagccgatgataagcttgaagacgttaaaggctttggggtacagaagagagatactaaagtaacagcctgcacatgagatcttgacctgtaatgaagtgccaatttagttgtaaagacagaacatgtcatctataacatctgaggaaaatcttgctgtgtatgcggcataacctcagtttataaaaatttgagaggaaatcacaagaatggagaggttttgcaaggttatggagtttgtacaccatttttttagaacatgaggtctaaaatcagatgcaaatgtgggctccacatcctattttttaggtaactttgaacaagtcacctctttgaacctcagtgaaatgcagctgaaagttctttgaaaactgtaaagattatttattattcagagatgatttctgtgggtataagcagaaaacactactttttgaatgaattacaaacataaaaccatgactttaatgctaacattttttgaaatttttataaaactttctaattcacgttcccctactgttccaaagtcagtaattttaagatacatgatttaaaaaggaaaaaaaaaaacctaactgtcaagaaatatcgctaactagattgatcatgttatttccttatttttataattgaaaaaacccaaaactttaatactaatttctggttgcttaaaaacaaattaaatataaaactgtgtggctgtcatagatgatgatattttaatctattgaaaattattacagtagaaaatttttaaagtctaggaagcaataatcagcaccaaaatattgtttttgctgttgtatgcacagctttagtttccattttatgaataaatacataaaaatatagggtaaaaatatatgtatttaataggattcttacaactttctattagcacaatgagtgcagagcatttgtgaataacatagaactagggtctcccctacagcttttgagttaagtctttttctaacaactgctatttattcagagaggatgcgaagtaacaggtctaaacattacattggcaaaggagtacctttaaattgtatgtggcacaagctaaatctgggaaaggaaatgaaacacaaatgaaagggcaacttcttctggaaacctcccttcctttgtggtatttttgtccttcctccattccatgaatcctattaagaaaaaaatttctcttttgctttctaattcccaaatctttactgcttttctttaacaaggcttccaagaagaatcggaaggtgaaggaagggatggccataaagaagactgttctttagatgagatttttgtcatattgttactgaaacaccaggggtttggtctaggtccccgctgctcccaacacataaggccaacgactagggtgatgagtatcgccaaggaagaagctctaatcaggtgctgcaggccaagagatggcagctcagtctcaaatctatctctgggacctactcaaactaggagtttatatagcaggaaaggattgtaacaacgtgtaagaaaacaggaactagggaggggaaaggaagcaatcatgatgaatgagggatctggcatctcattgtctggatgtgatgatctagtgagtttcagttctttgatactttttttgagaggtctgaagggtcatttcccaaggaaggaactcagataaaacaaatgtaagtttcaagctttaagaccagaaggattggctggtcacagtggcccacggctgggcgtggtggctcatgcctgtaatcccagcactttgggggtccgaggcaggtggatcagaaggtaggagttcaagaccagcctggccaacatagtgaaaccccgtctctactaaaaatacaaaaagtagccaggcgtgatggtgcacaccggtactcaggaggctgatgcaggagaatcgcttaaacccgggaggcggaggtcgtagtgagctgagattgtgccattgcactccagcctgggcaatagagtgagactccatcaaataaaaaaaaaaaccggaacgatcaatttctatatttatccaaacatgattgtctatgggactcctggatcagtttcaggcctccctttctatttatcaattcctcaatcatggggaacctggttgttgatcttcctggctgcttcctgctgaggaggggtgtcatgggcagctccataccatgggtgaccacatggccactcaggaatcaaaggttaatctcatattagagttttgttctgaaacacagtatttctctctccagcccccccacatccaccagagacaaattgttactgaaacaccagtgatttggtctgggtcctgctgctccccagacagaaagccaatcgctgagacaacagtgttgccaaggaagaaggctttaatttggtgatgcagcaggggtttatatagcaggaaagaatgtaacaatgtgtaagaaaacaggaactcgggaggggcaaggaagtgatcctggtgaatgaggggtatggcatctggtgtggtgatctgggttctttgatgctttttgtaagaggcctgaaggtcatttcttgaggaaggaattcagataaaaccaatgtaaggttcaagccttaacagcagaagggcccatttctatgtttatccagaagcaactgtctatgggactcttggggatggtttcaaaatcacagcaggaccaatctacctgcaaaataagcttcagtcccatatactagcctgattactcacacagaatgcaacaagatcattgtctacataggcattcctagacttgctttgctggagcctctgacaaggtcatttcagtcaaagccctgggaaataaccagttcctccaaccgggcggggtcggggggtccattataaaagcaaacatgttgttattatgcaaacaaacacattgccatgagttaagaatattcacaaatagtttacaaattatgaagaaattgagcagagagagaaataggcctcaatttctgtttataaaagtatactctattcggtacacttaaagcatacttaaagcctgtaaatatctcaaaaggaaaaaattattcagactctgaaaaacaaaacaaaaacaaacagcaatatttcaaacataaaaatcataaaagattatctcagtccttattagttcagtctatgcaatcagctcctgttctgcttcatattggattagtggcaatctttatacaacagcctttcaattaggggcctagaagttttctctctaatccaatggcacaatctccaaagttaccagaaacttccattcaagagtcctttttatgaactcttccaaagaagcaatgtttggactgtggctgattgtaagtcactttttgagaaggatcaaagcaaaacaacaattgtggataacaaaaagtcttgagacagccatagttagagacacagttgacaagaaaatttggttatttctgtggcatacaacaacttaataattataattattactgacaacatatatttaaaaataccagaattttaagaatctcatacaatcctggaacacatattatcaccacatttatataaatataacccaaaggaagataaacaccacctcagatttgacaatgcttcctgcataattctaacacaatgaataagcctattatgtctgtcttgcatgtcagggaacctaatatctagaaaagttagtttgaggacaaaaagactgaattcagaacttgaaattttactcctagaaagtttaccaaatatcaaagttttaagacacttaatatcacaaaataggatcacaagtcactataaaatagtccttcatttagccaaagtgataaatcaaaaacatttacgttttgatagagactctgtttcccaaacaaagacctaataaagacagcatgaggccaactgaatctgtctctccccactcccttttctctctgcaatttactcaaaaagtaaacaaaatcttttatctctcaatattacatattttgtttaaaaaaaccaaaattttcctttgaatggtatggtattaatgttaaagctaattttaataaaatattataaacaaatctatctaatttaaccactttgactataaggtacagatttctgtaaactttttttttttttttttgagacagagtctcactctgtcacccaggctggagtgcaatggcaccatctcagctcactgcaacctccaccgcccgggatcaagcaattctctgcctcagcctcccgagtacctgggactacaagcacccgccaccatgcccggctaatttttatatttttggtagagacggggtttcaccatcttggccaggctggtcttgaactcctaacctcgtgatccaccagcctcggcctcccaaagtggtgggactacaggcatgagccactgtgcctggccaatttctataaactttttgtaacctttttccaattttctattaaacagcagatcaatgcttcaagaaaactgttattccaagacatgggtccagacactattcttgtatcaatgagcttttgatattaatgttgtttaatgtatagaaaaactctgaactaatcctatgcctcaaaaatcagccctgacaatctcacatgactacctcttccacaataatccctgggcctagagggattaagtagttttaatttctggcctgtgtctcacgaaacagttccttgtgatcgtcaccttctccagagtctgaagagaaacctttgactgctgtcaatgctcaaaatttagcaggaattggtgccttcttcaacccaagagtcaaagccctgttacttaacagcacaagcgttagttaataggatgtttatactacagaaagtcctatcattccctctaacatgttacaaactaaaacactgtgatttggcatttgcgggttactgcctgcagcgcttcaaaccactgtgttaaagtagttaggttactcattgcataattgctaggattctagtgacagaactgtgaccaaaagcatcaaaacgtgacaggttctatgccaaacttttcaaagtaagacaactaatgtttcttgttgtcattttaaaaaaaatggtaaatgcaaatatcagttttggaaaaaatgtcatttaaaaaatggtaaatgcaaatatcagttttggaaattcagtataagaattaatcatctcctttcacttaaatactatacaacaaaacagggataaagtaaggaaaagcacacagcaatttattttcagctattttaaaagagcatcatcacacttttccaagattggtttctcgatgcagtgccgaccaccaacattttcaaagcagggcaacactggtgcatatcttgtttccaggtacacacatgaaggcccaccagtgataaacagcttaggatcagaaatcactacaaagtctcacatgttttaaatactattattgcttcatccaaatgaatgtcacttaatggtaataatgataaacacaactacaatagtttgaggaaaatcccaatcactataatttccttaaggaaaaggccaatatttcctgaacattaaatttgcatgtgtaacaggttttcctcattaaaagaaaagatctgaaaccaactcaaattattgactgtattgaattaccttggaaataaataccattgaaacatttttactctcacctactttttcaaataataaataatgtactatttctgttcagaagttataaaaaatcttttatgcagtttttttgccaggaaccttaaagctctcatagctctctagatcatcagaggtaaggaaaaccaacaaaattttaaatggctgatgtcctctatcaatttttggaggcttcacaaaggtatattaggaactttagatcaatagaacaaacaatgaattgttggaaatgtatagaaaacaaatgactacttatagaaccagatagtttcaagctttaagaccagaatggtcgatttctacgtttatccaaaaacaactgtctacgggactgttaggtctgttttttggggttttgttgttgttgctgtggttttgtttgtttgtttgttgacggagtctcgctctgttgcccagactagagtgcaatggcgtaatctcggctcactgcaacctccgcctcccgggttcaaacgattctccagcctcagtctcccaagtagctgggactacaggcgtcctccaccacgcctggctaattattgtgtttttagtagagacggggtttcaccatgttggccagactggtctcgaacacctgacatcaggtgatccatgcacctcagcctcccaaagtgcggggattacagacgtgagccaccacgcccagccgggtctgtttcaatcttcctatttgcagcagaattggtaaagtgagttaacagagtagcatcaaaatgatggtagtattgtgactgggacataagatgcatagattcatgatacagtgacaaaatgcagcgttcaaataggatcccccataactctatgctgtaggcatatacaatattgtgactagtccacttataggacatttctgtttccaaagttggcacgaaaaaaaagagacaaaaaacaaagacatgcccagcgaaggtcttgagtgctgggatctagttacaaaggtttgggaagtagattttttaatcttagaggactattcatggctgatactttctcaaatgtgccttagagatgcttccatttgcagcacacattccatagaccgcatcaatcactccattcagtcatccttgtctgtgtccttgtcttgccacgtgtgtctgctattctttccacaataggtgactctgggtccaggattcagacttgctttagccaataggatgaggtgagatgacagtatgggcttcacaaggttcacagtacctctgcttgcccttctgtgtctcggcctcagccatttttgggggtctcaggaggaagataaaagacaagtgggacagagccacacccaaggaccccaacccaacccagacggcttacactcggctggtgacatgcgtgagttggtgcaattaagactgcaacttctgatcctgtcctgcctggatccatccaccctgggaacttgtaagaaatagtgagtgattatagtttgaagtcattgagtttggtgtgcatgtgcctgtgcatttggggtggggggaggcaacaggtaataataaaggtaactaatctcaaaattgtggccttttctatttccaggacctctgtagaaatcatgtttttagtatgtacagactgaatgctaaacttttgtctccaaagagtaaatactgtccacaggggaggtctacagaaaagaagtaaatatatgagtcataatcagtctcaagatatagtacacatgtcactgaataaactgatgaaccaaatggctgaagaggaaaatttttaatgctctgcttcacactaataaaaacacagtaggctcaatttccatattctctgaaataatataaatgattttgcaatgatatatttacttacatttattctgctcattgaaatatttcctttaaggaaaaatacttggaatccaacaaatttcttcactcagtatcttcagcacatattcatacaggtaaataagcaaacaatttttatttaatatttaaagtatcaactaaaactatctgaaaattatcaagaatgtaaatgactatagagcagttaatttttttttaagaaaacttactgtcaacttgtctttcctttgatgggtgggataaaaggagtaagttacaatttcttccttcatctctgcctctttcaatgtcccttcctttatgctcatgtcagtctctctttaaccaaacttgtaagctaagtctggcaagacacatagcatttttcaagaagtcaataaacatttagccctctgaggagacatcaaagaagcaaattaaatttgttacaacgacttgatccgtgttcttttggtctaatgatttaagccccaaatccaaaagttaaaagaaagcagaattagttttaaatcactttgcacttaatctctctttgcctcttctctccccacagtactcattttttttacctagaatattctttcttaaatatactaggatacaaactctaatatacacagggaaatttgagcctttagtgcccaacagtgctcctcacagcacttagcatggggatttgtgacaggtgctcactctgctataaaccaatgttgtctgatacaccaattgacctagcatgaccattcatattgaaaatctttgtgttatcaaggttaatcttttcctattcacaaattccttgaaaacatgatacatagtgtcaaatattgccaaaattgtgaggtgttgtatctaaaactgcagcctttattttttaaggtgttataatagtaaaattccaggaagaaatatgccaagattgatggaaatactattgtgtttcacaaacaaatctcaatgtatttatatgtacgagtagtcttcaactttacaacaacagaaaaattaaataagaactctaacaaaaatttgtttttctttttgaatgttgaccaatttgtgattttaaaatttttacttgtgtctctgttaagtctttgagactatccattttgcttttctgatcttaagttctttccaaaaacacagaaactctccaagctgtcagtgtcccagatggaaccaaagttgtagtttgcactggacattaaatgccgaacttgaaattaatcagatctctacttgagtaaaatgaaagctatccaacgaaaaagcaccaaaatattgtacctacacagccaggaaaacatcaaaggccttcaaaaagctaatatatctagtgttgacaacctagtaccacacaagaactatgggaatgccaaggttacaatgtactaaaagcgcctccatgaagagatgaaatggtcaaatgtccaggactctttgagaaaataggggtaaatagctaaagaatattgaagttgctccaataatcaccaatatgtttcttctggtttttcttccccaactagaattaaaaattgtgtatgctccaattttatgcttgaaatataaaagaatcaaaattttgaataacacacaagtagatgtttttatttactttttaattttatggatacatagtaggtataaatatttatggggtacatgagatattttgacataggcatgcaatgcataataatgacataagagtaaatggtttcaatttagaaagatatttttgctggatacagaattctaggttgggagggacttttgctcttgttgctttttggcacagtcttgctttcattatttgtgataaaaagttagcaggatttctcatttttgtttctctttatctctgactgcatttaagagtttctcttaatgtattttcaacaatcttattataatgtgccttgatatgtttttcttagtgtttctcatgcttagggtttgtcaagatttttgatctacaggtatatttttattagaaaggggatcatgagttaaccagacatgagccatgcttgggaagctgttactgctcctgcggctacagacacaatggaaagaggtaaggtttccacatggacaatcacggcgggtttcctgacagaagcagggttcactgaaggtgggtgactgggagaaatactttggtttttccatacctgttcttccctaatcttctgtcagtacctcctatagtcagaatttaccctgtgatgaatagcagagcatgtgaaggctggaaacggagctcagagaaaatcagcagctgcccctcacaaaagcaacgtattctgatttcttcactgttggattcatgccatctggaagaacaactgggcatatatttgttgaatgaatgaatgaaatataactaaactcatgttttattattgagaaaattgaagctcctgcgggcttcacaatttactcaggtggttaagaactaggacttaaatttaggctatttcatattttaacatagcaatcacctctgacttctgtaaattgaatcatattttaaatccatatgagaactttctttccaaagacactctgtattgcgttttttgcaaaactgaaaatcctttatcacctttttaggtagatttttcaaatttcagtttctcttcaagctttctggactatttctttcgctgggaggttttacataacaactctattttaaaagaacagagcatttcaaaagggttatcattttggtaaaagagtcagcataatgtgaaagaaagagcatggtttttgataccagatagtactacattctgatctaggatttgcaagtaatagcaattagacattagagaaaacacttaactttcctggtccttgattccttattctgtgaactggggataataataccttctctaatcatgtcacagaactgtaagaatgaaattagatgatgcgtatgttatgcaaatacatttcttactattgcttagctgtgagtcaccttctctccagattagcttttattactgatactcattgtggacatagagtccagctgatagctggatgggtgggtatggctgaagcagaagcatagaatgtaagagacctgcaatagagacttcattgtctgatgagatctagtgagaacagcaacactcatagcaggtaaaagtgctgcaaaaagttggtaggaggcagtaagaaagtaactgagatgaatctacttattttgcatttcctatgctaatggtcatcttcattaataaagacaatccagtcactttaaaccagaggctggcatcacagtaaaaagggaccatttccattcttccagtatctatccttggcacttaaatccacgtgattttttaacagctttattgagatgtaattcacagaacacacaattcacccatttaagaacacagttcaatggcttttactgtatacacagagttatgcatctattgccatgatcaattttagaatcttttcactacccccaaaaggacctctcttgggtcccttagccattaccccttgagaaattcccccagccctggggagcccctcatttactttctgtctctatagacttgcttgttctggacgtattcacatgaatggaattatacaatatgtagtgttttgtagctggcctatttcgcttaacataatgtatttgaggttcaccatgttgtaacatgtatcagtactttatttctttttatagctacataatatttgctatatattttttcaagcattccacttcactgttatttgtttttccacttaatttacctgttctgatcatatgtaagatcaaaggagtccttgggtgttatgaattcaaccactgtttaatcttgaagagagaaagtctaaattgtcagagggtcctgagtcaaacactttcctgtgtgcaggaggacacggggccaggccctgccctctgactgtgcaccactggcttcctctaacaccgactccaaaatggtagaaattctcctccagataacatttaatcattataaaatgcttccttatcaaggaactcataatctgatcccaaatttgtattggtaaataggtaaaagagaactatatatttgaagcataaaatataattactggccaaaattctccagataattttaaaatagacatatcttacaatgagccccccagattgccttttaaaatgataatgtaaaatgtttgcctggtctcactgattacttggtaaattctgaatatgatgactttctgttcttacaatccataaacgcaacagctataaaagccacaagagtcttgatgacaatgaagaagcatttctgtgctgacaaagtcattctgctttagaactgtggatactataagccaacataagtcttctcttttcctccccatagcatgtcataaactttctgagaccatttgtaccaacgagacccagagcatgcatttatatgcaattgctgacgtttaaaatgcgataatttaataccagtactaacagaagctgcagaatcaagtgctattggtcctgctatttacactaaaatgggtaaccccagtgtgagtgacggcgaagtcctttcaaacccagaggttaaaatcttacttcctttcttacactccttttcatctttgcttcggtgtaaaatctgcatgacttattatgccattgttgaactgctctctgacctcattaacattcttatctcccagaaaaaaaaaaaatgttacaagagacctgtctggttattatctctgccacctaagacttaaagcttcactataatttccaaatacatctaccttgaaatatctaagcttacgtgtctcagctacttccccaagtatgctgaattctaacggtagagattcactaaacctattttctttttcacacttcataatccctggtacaggaaatggctcaaagcactaaatttgatttgtttttcaaaaaacaacaaagccataaaattctagaacagtaacactcaatcttaggatatacaacaggatacagctacagataagagctcttggtttattccggtgtttcaataggtatgaaattgatttttgcaaatagaaaattggcagattataattttacttgtggaacatttagcatattaattatgagtttgaaaattgcattttcgaatgatagtgagggcagcataagaactgtgaaaggataaaaggcatatctcgaaaaaattttaagacatataagtaagtatatcttcaataataatttaatgattgaaataatattacttattactgttttaggagcacttgatgtttctagtaacaccctggcagttctgtgctccttcccagatctttccatttctaccccaacttaaagaaaataacattacagctgaaatcaaagagaatttaagcatcatttggtttgagaattatctttctcactgggtggttgtcagacaacctaaacgcttggcttctttttttttttttctttgagacggagtctcgctctgtcgcccaggctggagtgcaggggtgcgatctcggctcactgcaaactccacctcccgggttcccgccattctcctgcctcagcctcccgaatagctgggaccacaggcgccccccaccacgcccggctaatttttttgtatttttagtagagacggggtttcaccctgttagccaggatggtctcgatctcctgacctcgtgatccgcccgcctcggcctcccaaagtgctgggattacaggtgtgagccaccgtgcccagccaacgcttggcttcttttatagcttcctccaaaagtgtgattcaagtcggtatgagggtagggtgtagggctgtttgctgagacagtgttgtccccaaactcacacacacaaacacacacatatacacctgtgtttacctatatatgcctgtgtatatgtgtaaacgtgtggatctctatctatagattcatctactgttggccaataggacataaaaaaacatccaagttttttttcattcttctgctctgctgggcggctgggggtcaggggaattgccgtttcttctcacaacagagacttattttcggtatctgtcctctacttcttcctcattaataaaaccctgcatttcagatggactcaaataaagatcacatccatttctccccttgaagtcagcgacagtaatgcatacaacttactatacctgttctttaaaaagggagcctagtcttctcttgctgtttcctgctggtaggaacacagacacacgtgtgcgtaaacacacacacacactgtgggagagatggagcagttcttgccccctcggactacagagtggaagctgcatgctcccagcctgcacatggcaagcatggaggttcctgaggcttgtggagctcctacagcctcactgggctcacttcacatgtaagtgttcaccaaacgtaggtaggcttctcatcaatattcactgggtcaatctccactttattctttgtgtctaagttcaaatcctcttaagctcttacctagggtttggtaatgatctcaaaattgttctttctctctccagatctctccctcccttattgtcttctgcctgctgttgccaaaatacaatttgtaatgtacaagtctgctcatagaaaataagtaacagaatcagaattctaacttatgtctatcttgatacagagctagaaatattagagacattgtggatagctaggaaaaaaaggagaaatttgacctaaaaagagggcacgtgttaaactcaaatgacagatgaaaggtatgcaagggctgagcatgccggagaagacgtgacggctatgttccctgtgttaggtcatgggtgagttattgcttgccattatttcatttgtacctttatatttagcatcatatctgaagcagcttttacacaacctggaattgctgtgaatgagcagccactaagaacgagtgcaggagatgagaagtgagtgacatttcccagcagttaaaaacccttcctgcacaaagccatgcctgactcacattcacccgtgaacatcattctctccctgtaaattctgcatgagaataatcctagggtttctcagttattaccatgaattgttcattagattgcgcacatggtgattttatctattgaacagttgaacctacttgaacaattctatacttctccataacaacccacggtgtaatatcacatttttaaaaaacactaaatgaatgagcttaattgagttgggtattttgtaattgaggaagaggcaaaatacattttttgaagagtaactccttgatgagagatgttaaatgattcatgaatccacatcagtgatggggctagataatgcagggttttcattcttagatcagaatccttagtctatcattagacccaccagatccaaaagataactttataaagtcaaagaaatgattttgtctacttgacttatagcctggatcatacaggaatattttgttttcatacatgaaaaatgatcatatttcctcactgatgttttacaatccaaactaaagcaaatccaaactaaagcaaaatcagatggttttacaatccaaactaaagcaaaacggtactttgagaataaagagttaaagacactgcctttatacaaataaaacaccatgtgtattaaaatatatgatccctaatgagatggtatttgaatgagaaaagctgggcatatcataattcttagcctagatatcgtaactgtgctttagaattggaccaagacactttcttactaagaactatctttagaagccattgtgtgcaaataacttctttctttaactagttggtggccttttattctgtgaggtatttaacatttaagtctgagtcacttgcttttaatgtgccacaatgatgtgatcccttaatatcgctgaactatgacagtgacatcctctttgaaaagaccaagctaccattagaaatgggtcatgaagcaaaagtcattaactcatttaaaaaaggccagagcccagcaccgcattactgacaaacctccttccctgtgtccatttgtctttatcaaatatcactttaatatccatctcccaagcatgagatagggttgtgaagcagctccctttgaaaaattaaaacccttagcaattaaatttgctttcaagtttcactttagatgagcaacttaattcttgtatgcaatattataaagtaagtattaataactcccagtaatacaaataatgattccagagttgctagtctgaaaacatttgaggactctttttttttgagacggagtcttgctctgtcacccaggctggagtgcagtggcttaatctcggctcactgccagctccgcctccggggttcatgccattctcctccctcagcctcccgagtagctgggactacaggcgcccaccaccacgcccagctaatttttttgtatttttagtagagatggggtttcaccgtgttagccaggatggtctcgatctcctgaccttgtgatctgcctgcctcggcctcccaaagtgctgggattacaggcgtgagccaccgcgcccagccttgaggactcttaaaagaggaaaattcaattaatagagtcaatgatgaaaaagtcaagacagagtttctaatattttccttgatgttagttttgcagaaagacaacatgagatagaggtcgtatcttttccacataccaaatgagaggtttattttaaaataatgttaaagtagtaacacaaatgatagggaataatatatgtcaacgtgagtgggcttcttgtactaacattttaagttttatatcagaatgagcttccaccttcagcattcaaatggaaatttctcacaacaaggaaagataatctatgctctaggaatccccttctggtagacaacctttgtagaatcaatttttacgtctgttttcctctgttatatctctcagaaaacaaaaagtttcatgaattttttcttctctgggctctcagctacagatgctgttgcaaaatgaggcaagagtgagttctgccaagagcaatgtccatcatgcaaaatgcctactacctaggagctttcagaagaagtaagacaaaggctgaacatagtagaagtttgtgtttctttccttcaactgaccccatgacaggaagcaggtggtggcagctgtttatccaataaaagtatttttgtttgttttgttttcttttgctttgaatggagtcgcctatcatctcagatctcagatatacctataaataaaattttaaaatttaaatattcaaatattttggccaacgtgcaacacaatccggttgctctttaaaagcagagataaagctattttataggcaaagcaaagcgcacagtcacaacagaacagcactggatgtttgcgttttacttattttatttttattttttattgatttttatttttgtttttttttacaagacggtactttcattattgaactttaaacatgaaagattacatttctacaaatataatagaacaaaaatgaatgtggagaaaaaaggaattatggtaactgtacagggcatgaaatgggcactttccgatgattgagcaagaaattaagtacagattataatacattctttttaaattcatttgacacattttatctttatttataacctattcttgtcttcattttcctcctccctcctcccttcctcttccccctttcttcctttgtctaccactctgatcttcatttttcatttcacttttttcttttttattaagcatttgtcatgtattttataaatctatactcctctgttacaataggtattagttattctgcagcagatcacctcagagggccccacgcaccccacaataatccctccacaaaccccctccacatttgtttctcagagctgaatctttaaggccacctgctgctgggggcaggcgccctccaatccggcagcttggatggagctgaagctgtccacgcggaggctcctgggcccctgacctggcctcacggtgtctccttcggctgctgctacatccttcctcctacctctgctgctgctgctgttctattatacgtccgaccttgacccagctctgttgcggtgttgacacctgtctgtcagcactcgttgaattttagaaaatgcttgacatattttctccatcctcttattttcagtctttctgagtattcctgttttcagtttctcttccagacaagatatttcttcatccaattcagggtgtcacgttcttttgtttaccttgggttttaatttgtgtaattagtattaaattagatcttatttttgacatctttattcacattttcaatttaggtgtaaattataattattattaaattaagggccaggtgtggtggctcacacctgtaatcccaaaactttggggggccgaggcaggggggatcacttgagatcaggagttcaagaccagcctggccaacatggtgaaaccccgtctgtactaaaaatacaaaaattaccaggcgtggtggtgcatgcctgtaatcccagctactcaggaagtgaggcgggagaattgcttgaacccgggaggtggaggttgcagtgagctgagattgcaccactgcactccagcctgggcaacagagcaagactccctctcaaaaataataataataataataataataataataataataataataattaattaaaacttatttctgccatctttttttttatttcttctctttcttcagacctttctaccccccttctttcctcctttcaataagataacttcacattttctctttctgatttaaaggtaacatctttctatttttataattatgattgtcatatttatgacccatactctttttattctgtccttattaatttcctaaatttatatatattcacatcttcctcctaacacaataaaaactagattgtttctaatatttattttgtcttgcctctagtgattatgttgttatttcctagggcttcagttttagattgctgtggatagacttttacttgttttcatccttctacttacctaacaaaaatgagttttactaagatatatatttatccttaatatctgttttttttttcttcaaaatgtgttttaaatgagggccattttatagttaaaagttctgaggccttttaaatgtatgaaaaaacatatgaaaatacttttataaagccttcatttttatgagtcagcttctctttagattcatagttctttttctttagtacattaaaaataaccctaaattttcctattatatttagtttgctactgagaagtcagctaatctgattgtttctttgcagatgatctttcttgctgacattctttaaattttcctgcctttgaattcttaattctcattataatatttaaatgcaaattgttccttatctttccatttttccttgataaactcttcaatttgaagtctttcaagtttctttaattctgaaaaatgtctattaattctccgcatttttccccttatcttttcacttttctctccttttgggactcatccaggtattgatatttattgtattctctatatctttcagtttttctattatgttttctctttctttattccctcaaggaattccttaatctgatctttaaactcacttatttactcttcagctgtaaacatcaaaatattccatctattatgttctttatatcagcaattatattttattatataatatttttcctatattctattttatgattatttcttattttatattgttaacatcttagattatcatcttaactatacttatcatccatttataaaattcttagtctacctgctctgacaattctcatttacaggatatatagtgactatttcatcttgtttctttatttcagctcataaaggtgtaagggccgtatttgtgccagtcttgggtaagtttgaggaaaaagctagggttaagataaaatgcagagagcccaggcattgtaggatccctctcatccaatgacattcctccaaacagtccttctgatcatggctgtacttcaaagtcttaagatgaagctctggccaggcgtgttggctcacacctgtaatcccagcactttgggaggccgaggcaggtggattgcctgagctcaggagttcgagaccagcctaggcaacatggtgaaaccccatctctactaaaatacaaaaaaaaaacaaaaaaataggcatggtggtgggcacctgtagtcccagctatttgggaggctgaggcaggagaattgcttgaacccaggaggcagaagttgcagtgagccaagattgagccactgcaccccagcctgggtgacagagccagactccatctccaaaaaaaaaaaaaagatgaagccccactcggaaagggcagcctctctaggatccggtccaccagccctgagtgctgtgagaggctagaggagtgaatgtctaagggcggctggtaggtccacatttttccaaagatttcccaaccttacaagacttttgatctgcttactataacttcagaacacatctgtaagaaactgggctattgttactttttgctattctggaggaattttttttaatgaattatgaaaacttttctacaatctattatgttgttctcttgccaaaactttcaaccatggttcaaaccaggaccatctacctagttttcccatccacatcaactcaagccagccttcagtctccctagggtggtttctctctcctctctccctccatctctcccttcctcattccctccctccatcccttctctctctctatgtctgtctgtctgtctctctctctcttcctggtatctttctccttgtatctacagtttgtcccacattgattttgggggactgcagcaatcagcagcctcagcttttcccagaggccttgctcatacctcccaggcctgaacacctaaagaacccatagctgctggacccaggagggatggttgaccagttgattggagttaggagggaagcacagttggaatgcgttctaactgccatatccctagaatcctttggtgtttaatatttagtgcaataattttcatgtagattgaatttaactaaagcaagtgtcatggctttgtcaggaatcttaatcatgaaactttccttggcttccagtatctatttgtggtaaatgttaacatgtacctgactaggtggctcctgttgaaagcaattgcaaaaataaaggcatagagaagtatgagtgaaggtctggattacactttctttcaaataagaattcagcatgcattcttttttccagagatcttaattcaagatccataatattgcatctttctcttttcttctaaaccacagggtaaatgagccctaaaataattgtgggttctgaatcttcactggattctacttatgtcacctgtctcttcaattctctaactacaccctccagacacaacctctgaataagtgtccccaagcacctgacactctcacttccacgcctttgcagattccttccggcatggaatactccgcacttctcatcttattctcttgttctgcctattctctgctcatgctgaagaggcttcttggcgccttttcactaagacgattggtgacgaggccttctcctggaagcatgacatcactcacctctcccagccgacgccatgctcaagtctccttgcatgagaccatcatactctggtttggattttgtaatttttatttgactttttctgccactggaatatagggtctttgagatcaggactctatgtcctagacatttttacactcaaccttagccccagttagcttttagacaagtaattattgaatggcagtaaatattccttgggtttcactgaagtctgctctaaatgcagttgagtttaatgatcaagagcttggactctagcatcaaatgtgagttcagattatttctccattacctcctagttgactaacacctactttctgactataacaacaaatgttactgataactatttctaggaaattcattaataacatatctattatgtagtaacttatcaataaagacaagctgttgtaatttgatcaggtcaacttcctttcattaaaaaaaaggtgaaattaactaaatttatctttggtatgcccaaaaccactctcccatctctccagtaacttctctgtgtctttatgtgactcgggacacttctttgtcaggagataaaatactttgatgaggagatttacataaaggcgtaagtaagaacgacttaaaaaattatctttgataacatagttgctgctaatccaaaggagaaactttaatgctggaatggcaggcattaacaataaataaaccgctggaagtaattttgaacgggatggcctatgggaaacatcctagaaatcttactatgtaaggaatctacttactcatttattcactaagttgaaaaattcatactgaattcttgctgtgggaaatatttttctgggtgtgtagaaatgtagagatttatattacttacttttatcctcaaacgtgctcataatctaacaaagcagacaataatatcttgtatttatattgttttacatatatttacttataataactatcttgtgatgaaggttaagaatttcattcccagtgttcaggtttggaaaaggaattggatttacccaaggtgatacagctagaaagaggagaaatctatactcatatgcagttctcctgaatataactatttttcccccatgacacaatgcctatacaaccataatccaaataaactgataggtatcataagtgccaaagtaatacatttagatgagagtaaaattaatgtttgcaattaattagtaatggtctcatacatagggcatttcagtgcgtgggcactgaagaatgaactggattttgacaggtggagatggtggaaaggacattccagactggaaaactggagaaaaaataggaagtgcacaacagaggtgggaaagaacagatcttttttttttttttttttttttgagaccgagtctcgctctgtcgcccaggctggagtgcagtggcgtgatcttggctcactgcaagctctgcctcctgggttcacaccattctcctgcctcagcctcccgaatagctgggatgacaggtgcacgccaccacacccagttaattttgcttttgtatttttagtagagacaggggttcaccatgttaaccagggtgatctcgatctcctgacctcatgatccacctgcctcggcctcccaaagtgctgggattacatgcatgagccaccatgcccagcctagaacagatcatattgtaggaaggccaaccaccctggctgactagaatatggggtatgtgaaagaaagaagtggttttgataatatttaaaatatagattggaactagattatagagaattgtaagttttcactcttttccaaagccagtagtactcaggcctggctcagaatcagagtcgattttgcagcttttttttgaaatgcccacgccttggcagcactcccagagatcctattcattagctctcaggtgcatggacatctgcatattttaagattcctctattgatcctgccctgtaggtacagtagagggtccgcgtcatggtgattgaagcgcggtccacttggcgtgtggtctgtagactgtgctagttttcaaaggattagtgcccatgaagagaaattgaatagtgaaagggtaaaaactgtatagcagtttgatgaagtaattttatatctgttgagacacagaacttaaaaatggcaatgtgttttatatgtgttttgttcattcttgcacaattcatcttattatattttacaaagatattgttacctgagaattggaaattaaaaacaaaaacaaaactgggtttttcacacagataatccaggaagtgtcatcactccaggccacggtggcattcgtgaatgggaaacaatgtttggaaagtgtgccgttttgacatcagtgtggctctggcacgttggatggatgagatgagtaggaatcagtgtgaagtccgcattacaacatgcttggattcagttatgccaatggtaatggaaagaaagaggaaagatttcagagaagtatgcaaagaaaaaaaagaaacaaactgtcaatagatagaataaaagaaaagataaaatctaaaaatgttcttgatgtttcatgcctgcgtgactgaaaaaaaaagtgctactatttagaagtatgtagatatcattaagaacatttgggggcaaaaagggggtggaagtgagggtggagacagtgattttagctctaggcacattcagtttaagaagtctgaagtaaggccgggctcagtggctcacgactgtaatcccagcactttgggaggccgaggcaggtggatcacgaggtcaggagatcgagaccatcctggctaacacggtgaaaccccgtctctactaaaaatacaaaaaattagccgggcgtggtggcgggcgcctgtagtcccagctactcgggagactgaggcaggagaatggcgtgaacccgggaggcggagcttgcagtgagccgagatcgcgcccctgcactccagcctgggcgacagagcgagactccgcctcgaaaaaacaaaaacaaaaacacaaagtctgaagtaagtcaaatggaaatgtttccaaagccggtgaacatatgggccctggaacagtgacagtcacagcagttgggatcataatcaggggtggtattaaggacatattcaaagtggccagtggagcacagcactgacagccccgaaggcacagtggccataaatgcacgacgttgccaagggagtgcctgcccactgaagggcagccctggctagaggtgggataaccctggataagagtgggcagggagggggatctctgagggagagatgatagagaaagcaaagagattgtaaaataactcttagtgaaagtgagaggagaaaggggatgtgggaaatgtggaagaatgatataaagttggttttctttctttcttttttttttttttagacagagtctcgctgttgttgcccaggctggagtgcaaacctccgcttcccgggttccagcaattctcctgcctcagcctcccgagtagtggagattacaggcgcccgccaccatgcccagctaatttttgtatttttagaggagacggggtttctccatgttggccagactggtctcaaactcctgacctcaggtgatccacccgactcggcctcccaaagtgctgggattacaggtgtgagccaccatgcccagccagttttctcttgaaatcaggaagagaagaaattttaaaatgaaaagaacaagatgacaaacattgatgaaccatacagagaaatggaagagaatgagaaataagtaaagactagatttagggagcaaaaataaacaggaaagcttgaagaaatcagctttagtatgttaggaaaaatttaagatatagagcaatgaatagcaatatttggtaaatgctaccggctggattgtgacgccctaaaacccatatgttggagccctcattccaatgtgatggaatttggaaaagggaccttggggaggtaattaggtcatgaaggtagagccctcatgagaagatgagtgtccttactgattttatttttatagatttaggaggtgaaagtgcaggtttcttacaggcatatactgtgtactggtgaagtctgggcatttagtgtactcatcacctgagcaggaaacactgtacacaacagttaattttcaaccctcacccccctcccaccttccagcttttgtagtctccaatatctaattttccattctgtatgtttttgtgtacacattgtttagttcccactaataagtgagaatgtgctgtttctgatttattttacttaggataatggcctccagttccatccatgttgctgcaagacataattctattctttttttttattattatttttgagacggagtctggctctgtcgcccaggctggagtgcagtggtgcgatctcggctcactgcaagctctgcctcccgggttcacgccattctcctgcctcagcctcccgagtaactgggactacaggcgcccgccaccacgaccggctaattttttgtatttttaatagagatgaggtttcactgtgttggccagaatcgtctcaatctcctgacttcatgatccacccgcctcagcctcccaaagtgctgggattacaggtgtgagccactgcaatcagccgattttattctttttatgttcacgtagtattacaaggaatatatatgccacatcttctttatgcagtcgtctgttaatggactcttagtttgattccatatgtttgctattgtgaatagtgttgtgataaacacaggagtgcaggtgtcttttggatgtaatgatttatttccctttgggtagatacccagtagtcagattgctagattgaatggtagttctttttttagttctctgagaaatctctgtactgttgttcagaaaggttgaactaatttacatttccaaaaacaatgtatatgtgttccctttttcttgcatcctcaccaacatctgttgtttttagactttttaataataggcattttctctggtgtaagatggtatattcttgtggttttaatttgcatttatctgatgattagtgatgttgagaatttgcttatatttttcttgaccatttgtatgtcttcttttgaaaaaatgtcttttcatgtctttcccccactttttaatggggttgtttttgccttgttgagttgtctgaattccttgtagattctggatattagcctttggtcaaatgcatagctcacaaatattttttaccattctgtagattatctgtttattgattgtttcttttgctgtgcagaagcaaatacaaaacactgatgaaaggaatcatggatgacacaaacaatagaaaaacattccatgcttatggattggaagaatcaatatcattaaaatgaccatactgcctaaagtaatctacagattcaacacaattcctatcaaattaccaacatcatttttcagaattagaaaaaaaaatcctaaaattcatatggaaccaaaaaagagcccaaatagccaaagaagttctaagcagaatgagcacagctggaagtatcacatcatctgatctcaaagtatactacaaactacagaaactaaaacagcatggtactggtgtaaaaatagacatgaagaacactgaaacacaatagagaatccgcaaataaagccacattcctacaaataactgatctttgacaaaatcaacaaaaatatacactggagaaaggacaccctattcaataaatggtactgggaaaattggagagctgtatgcagaagaatggagctggatccatacctctcaccatatactaaaattaactcaagacagattaaagacctgaatgtaaaaccaaaaactataaagatcctagaagaaaacctacgaaaaattcttctggacgttggcctagcaaagaatttataaccaagttctcaaacgtaaatgcaacaacaacaaagacaaatgggactaaattagattaatgtctttaaaagacaaataggaggctgtcatctgcaagccaggaagaagtcccttaccaagaactaaatctgcaggcacccagatcatggggcttcctagcccccagaatggtaagaaaaattttctgttttacaagccacccaagctatgacattttgttatggcagcccaagcaaggaatgacactaaagaagtggaggcagtgaatataaagtcttcacaatgctaccaaataaatgaaagaaaaggtaagattgtcgtttaagaagggtgaagaaaacaaaggcagtatttgaagagtgagtggctgaaaattattcagaaatgatgaaagacatcaattcagagatactggaatcccaagaaatatcaaacaaaataaataatatatattcaatccattttaatgaaactgctgaacatcaaatacatggaaatcttaaaagtactcagagatagcaggcatgtaacttgctacgtaaactgaaaacagatttttcaacagaaacagggcaagctggaaaatcgtagaatcatattttcaaaatgctaacagaaaactcagaaattcatttccagcaaaaatcttccaatgggaatgaaggcaaaataaagacattttcagacacacagaacagagcttgtcactaaatacaattttctggcagaaggaaaataatcccagttagaaagttgtgaatatagaagggaataaaatatgacaagactggtaaatatgtgaaaaatttaaataaagatcaactacattaacttggcccaggctggagtgcagtggcacgatctcagctcactgcaacctccacctcccaggttcaagtgattctcctgcctcagcctcccgagtagctggtattacaggcacatgccaccacatccggctacttttttttttttttttgtatttttagtagagatgaggtttcaccgtgttagccagatgatctggatctcctgatctcgtgatctgcctgcctcagcctcccaaagtgctgggattacaggtgtgagccaccacacctggccaaaacttatgtcttgtagagtttaagatatggaaagtaagtgacaacactgtgtaagtcacagagcagtaaaagaagttggaatattttaccacagttgcaaaaaggagagggtttgtgaggcccgggcttctttatatacaagaaaaggcaacactgccaaatccgagtctaggcgcccagaaagctaatgcaaaaccagtgcctaaaggaggaaagtatcaatgtcaccttgaaagtgaacagagacactactgttattaaaaagaaaaacaagtcatgaggaagaagaatgtattgagtcgttagcatgctcaaggaggtttccacatattaatattatcttaatttatgttatttattcctgttatattctaatactatgtattattatttatgctaatactatgtattattatctcctttttccaaggaggaaactgactctgtagggtgagctaactcatcctgaatcaaagctgcaatgtggagattggtgtgttccattacatctcattgcccctttagaagcaggctgtgctggggaccaggaggaggccattggatgggtgccaggaagctcagggcttcaggcatggctgaccctgtttccactgggccccagggaaattgaagccaaatgtatgaggatggaacagttctgaggctttcataagttattttctgtaatccattgaccattttgatgatcatttttcctcccagaaaaattcacttaccccttttctcttctgtggactgcattgccacattttcctctctcatttgatttcacaagtgtccataatcttacttgctcctttcctttggcattttctcttggaatctaagtatctctgttttttatattttatagtcacttgcttcatgtttatcctctttttgttttctatctctttctttccccaaagaaataagtctttgctgcaattcataggggctgatattgaaccatacgtccagggtattactttacaatgtccataagctcccagaaatgcaccagaaatacgccaacaattaaatgacactttatttctgggcgtaggtaggggttcttgctgcccaagcacagcctggcagacagaggcaggacttcaaatgaccactgcaagcctctctttttgacggatgcagctcatccaatacaccaagagaaggattgtccaaattaaaatctatttctaacaggaacccatcaggaacaatccctaatactgttcttccatgaagaataaaaaaggtaaaagtcatataaaagagggaagacatggcaagatagttacaagaatattttcagagtataagttttaggaaatatgctgaattatccagtgttttaattaccctgaagctggactttccaaccaaaactcataatctaattaaggaagtccatcatatcaacagcacataaagcaacaagcaattaacattttccaaaaatgaaactgatgcaggagcatttcgatttactctaattatactgtgaatgctgtgcctaatgcaacaatgcctttgcatttaaaaaattgtctttaaaggtctccctccaaattgtaataggcttatatttctcccattctagctgcctgtaatatacataaaaatgagaattacaaagaattctcaactcatggatattataaaatatagatgacagaaacttggccctgaatgctcccacaagaacagtttgcagcaatcacactacaaagagttgtaaggatagcactttgatcaatctgcttcattcatctctatgcgcttgaaagaaatgtcttggaaagggctaagagccagcgttcctgaacctccgaatacaggcttgttcttgcaccagatatcgtgcctaccgcagtgcagagctcgctaagccttcaggaagcttttgtttcagaccacagtggtgtgcactcctctaaagcatatgctgcagtacatgactgagccttctgtcagctgatgaactgcatctgactcctggtgtttaaagggtctgaaacaagcatatcattctgcaaagtctgagattcaaaataagtaaatcctattgattatatcagtagaaattacaatcatgggattctagaagtacagggaaactggaggaaactccagatgaagaagctgacatccaggaaataaatagttgcccactcctacacaaagtgggaaacaaattggctttattgactcctaaacttttggaatcagaaagatctggcttcagattcaacttttccatttaatgtgggaatgtgagcgagttacttccctagccctttggtttcgtggtctttaaaatggaaacagtaatacagaccccttacaacatgaagatcagatgaaatgacacatggggaacctttgatgttcccactgttctgagctgcaggctctctgaagtgatcttcttccttctcatgtcattttctgaggtaataaaaagcagatgtgaagtaaaaatttgtcagataattaatcaagaagaaaaaccagagcaggcaggaccttcagatattcaaaatcataaagttgacattttatctaaattcctcaagttggcttttcatagaagctatataactggtgtttcacactgcacgtcatgtttttaccgaaataagaggaagattacatccctaaatacaaatttactaccaaatcatgacgtgagaataggagaaatagctccgtgggacattagccaagaaccgtgataaataagaagagagaagaaggttgggtgctaagttagatgataaagttaccatgattttctagctaataattatcctacattctcagatgcctgaagaaagatacatgtgtttgtgtgtatatatatatatgtgtgtgtgtgtgtatatatggcatgcaacaccataaattaattagatgtgccttgtatcacatagcttgaattaagaccatagaaaagataacagaagtaagaatttaaaaataggacccaatataaatatctatttgatttatgagtgcatttattaattcatatatttattgatacttcctctgtgaataactgtgcaagttttagaaatataaaaatgcagctggtgcagtggcttacacctgtaatcccagcactttgggaggccaaagtgagtggatcatgaggtcaagagatcgagaccatcctggccaacatggtgaaaccccatctctactaaaactacaaaattagctgggtgtggtggcgggtgcctgtagtcccagctactcaggaggctgaggcaggagaatcgcttgaacctgggaggtggaggttggctccactgcactgcagcctgggcaacagagcaagactccatctcaaaaaacaacaaaaaaaagaaatataaaactgaattaaatatgatcccagccatcaaagaatgcacaattctagaataacaaagcataagcttatagcactggcatggtttcctgctgagtctatagagcctgcttccaatgttatcatgccactgtcaaaagacatacaaaattaaacaatattttaaagagcaaaaaacctctgtgtctcaaactccaacaaatactatttctacaggacatacaagttttcaaatgctttgagttagcctttcacaataaattattttccaaaaaaatgatttttaatgtgtaaaaatttttctgctgtgagaaaaaataaaatattgtttaaaatcttaatactttaacactttacaatactttatatattattttatataattgtcctcatagagtatatgtaagtttgtgtcatgtattatatgcctagtgttacatcctaaacatgtccccagtggtaaccactgtttgtttttatggcagcactgtattaaatttaagtaataatttactgaataatgtctgtattgttggatatttagaatttttctgctttgtgatcataataaacaatgtaattggtacagggctttaaaatgtgataattatttagaccatcactgaagtcccaaaatactagctaccatattccaaagttaagtcaagaaaccatgaagggccgggcgcaggggctcatgcctgtaatcgcagcatttcggaggccgaggtgggtggatcacatgaggtcaggagttcgagaccagcctggccaacatggtgaaaccccgtctctcctaaaaatacaaaaattagcagggcgtggtggcgcttgcctgtaatctcagctactcgggaggctgaggcaggagaatcgctggaaactgggaggtggaggttgtgagtgagattgcgccactgcactccagcctgggtgacacagcaagactctgtctcaaaaaaaagagaaagaaagagagaaagaaagaaaggaaggaaggaaggaaggaaggaaggaaggaaggaaggaaggaaggaagaaagaaagaaagaaagaaagaaagaaagaaagaaagaaagaaagaaagaaagaaagggagaaagagagaaagaaagaggagggaaggagggaaggagggaaggagccatgaaggacctgtgcagatattgggaaaaactgtgttaagccgggtcatatccctgccccccacgaatgcttcctcctcatctcaagtgacgtaaggcgatttccaagagcatgctatgaggctctgggaatttggaacctcgtggcctggtctggctcagacaagagaaatgtaaaacacaggagaccttggctggcaaggagaggttactgcattgttggacaaaggatgtgtggcaattgtctcaaatactgtctaaaacacgtcagaaagagaaagacttcccagatgcctcaaagattagcgaaattaccagcaacctgttaaaaaagaagtctcaccaatattaagagaacgctaagtaaaagatccctggaaatacggtcttcaaagaacccatgtgagcatccaggagggacgtgttggcttaaatacctgccagaccaaaggagcgcctgtcccttctcattccaatcagtgaagtgaaacatggcagcctcctttaagtgaatgtatgtagtgtgtaaggggtcggagagggaagccacaaaagcaaaggagggaaaaacagaggggaaatcttcctccctcccatcacaggactgaggctgaggagacaagaaagaatctttttaaataaatatgaagctgtaatcactctactagagtaaagaaactaatttgtaagtgattcttctttgtttttctaaccataagcatcagtaggactcttcactatctaagaatgagttgggggaccacgagatctgagctccttgtcatccaggaagatgggaggaatgagttttacagaatggttgtaacaagaagtcagcagatagcaagctgatacctgataccgtaccaagagtcttgcttttccaacataacagtcagactataatacagattacaatttgtaatcccagcattttgggaggccaaggcaggaggatcccttgagcccagcaggtcgaggctgcagtgtgctatgatcacactgttgcactccagcctgggcaacagagtgagaccctgtctcttaaaaaagagagaaaaagaaaaaaagaaaagaaaattatgttgcaattacattttgcattcttttagtatatctcctttggataaatcctcagaagtgagattgctagggatttcatgcaggtgccatcatttacttaatcaaaccctatttgcaaacaatctaggagtttttccttcattttttatgatgatcaatgatgttgaaatggatgtaattttatgtaacagatttttcctccttttgggctatttactgtttatgtgtgacccatgggtggaaattgtttttgctcttgatgcatttacaaatggctctctaaagggattgttcccccttcattattaccagtggtgtgtgaacatccattttactagaactagatattatttaaatacaaattaataaatataaaatatcaatcttttaaatttgaatctcttctttcactaaaaatattatcccattcacttaccatttacaatttctcctttgtggagtggtttatatttttgtcaatttatcccaaagggattttctgattatagactgctcatgttctcaccccaggctctccagctgcatctgtaccagcagggggaaaaggaataaaataggtgataatataatcataaatatttgcaggaatcctgctgtccaagtttcctactactctgggcattcacatttatttatttatttattatttattttagacaaggtttggctctgtcacccaggctggagtgaagtgccacgatcttggctcactgcaacatttgccttctgggctcaggtgatccttctgcatcagtctcctgagtagctggaactacaggtgcatgccaccatacctggctaattgtgtgtgtgtgtgtgtgtgtgcgtgtgtgtgtgtgtatgtgtgtacagaaggggtctcaccatgttgcccagggtgggttcaaactcctggactcaagcgatccacccaccttggccttccaaagtgctgggattacaggcacgagccaccacatttaattcttaataaagacaatggaatttctaggaagaacttcctcttacgaaaggagctaatttgttttcttttgcaagatatgttgtatttatcattataacttagatcaaatgaaaaaaataacaagggaattttgcatctttttggtaaaaaaatctgataagtttcagcaatattaagattactgtaaaggcttctcttcacaaagagtctaaataggacattgaatagcttcttaaccaaaatgaagtaaaatttgagtaactaaagtaaaataaaatttttcatgtctgagccagaccaggccacgtggctccaaattcccagaacctcatagcatgcgcttggaaattgccttccgtcacttgagatgaggaagcattcatggggggcaggggtatgatctggcttctgacagctttttcccaatatctgcttctcttgccctcatctccaaaagcctcagacctttggctcacaagcccttcatggtctccttctttcttcttcttcttcttttttttttttttttgagtaaaagaacactaaaacagcaagaaaatttttctgtagttatcagaaatttcgctgttatgcggatagctttgtttttcattattaaacataattttgtgtttcttctaaaagaaattatattttgcatctaaacgatagccacaacaaaatcattagaaagatattatacaaccatatccaagtaggataaatagttgttgtagaaatcacaaagcagaaatacgttatcacaatcagtgaatttgatttgaattttagataatcatatatttctacccaaatgaatcttgcatttatatctatgtgacagctgccaaattggcctggaatggaatttggctgatgtaatttacaacagttcatctatttggtttaaacaaatagcaaagaccaggaataccagagttgggacatacctgatttacaaagagcaatcagacgaatcggtgttttcattctactcagatctacccaggttgtgtcactttaggttaggacacagtcgtggagattttgtctttaactgctatgcggttttggttgtgagaagccaatcaccttagaactggcttctgccactttttggagggaaacatcagaaaaaagggcaaagtagagttttctctccttggctttctttggttattaagagctccccaccctctctctagtatttgtgatgctgcttctgtccctctacttaatcctattgaagctcacatcacactctagcctggcatcatttttgtgagtcttagagataaaaatggtactggagtattacttaataaaatccacccacttttctaaatacaaacaaaacaaactgacaaatgaatagaacaattacttagcaaccaatgggtggaggatgacctcctgacaaagggtgggtaccaacagtatttaacctgcagcatatacttagcagaaaacatcagaagcctgcttgttaaatatcccagcaacaagacacaaatactccctatcactggtactattcaaaactgtagagaaagtcctgccaaaaatatacaagctaaacgtgagtgataggattactggaaacaacgaaaaaagaaattctacctagaaaagccaaaaaaaaatcaactgacaaactggtaagtcactttagccagctcaaaatataaaataaaagcaggacaaaatcagtaacatcagcactaggctacttgaaaatataacttaaaatgttcaattacactagcaacacacttatctacataggaagatacctaattagaaaagggtgagtcctgtatgaaaaaaacataaaattgaatttaagaacataaaagaaagtgaaaacagacctacatcctacgccaggttaagagagttccatataatagaaaagtttttaattcctaaattaataaattctgttcaatttttaaagataagcatgtttccaagaaacactaccattcaaagcttcatctggaagagtgaatttaaaaacatagacaaaggaattttttttttttgagatggagtctcgcactgtcgcccaggctggagtgcagttgcgccatctcggctcactgcaacccctgccccctgggttcaaacaattctcctgcctcagcctcccaagtagctgggattacaggcacccgccaccttgcccagctaattttttgtgtttttagtagagatggggtttcattatgttggtcaggctggtcttgaactcctgacctcatgtgatccacccacctcggcctcccaaagtgctgggattacaggtgtgagccaccacacctggccaacaaaggaattttttaaaaagaacaagactgtgaggtgaagctaaagaactagcccttaacaacataaaaacataccataaagttgtaataattcagttaatctccattactgttttaagtgaggatttggcataagaaaggaaaaaatcaatctgtgaaacagaataggaaatatagaaactgacccatgtgtataactcatgtgcagaatgataaaggtaaatcattcaaaattgtaggaaaaggatggataggaaaatacaataaaaatagaatttgaaaacctatttatccatttgtggggtaaaaataactttacagctcacatgtcatatattccagattcagtaaaaccataatattattgtaaaaaatagaataattttcagaatatggaaggccttgtaagtaataactgggaaaaaaacaataatgggaaagacagacaagtttggctacatagaatgtaaatttttgtataataataataataaaagtaatataaatagaagtcaagagacagactgggagaaactcttccacttagaaaacatacaaagacaataccacacattggtgaagaaaggatgtagactgcgtttgtctgactgtctgactttgtgcccagctctgccaccaactgtgaccttgggcaaggtcattgtcatcaatttgtttaatatagttgctgctttggcatccattcctaagccagacattttatatatatatatatatatatatatatatatatatatatatatatatattcccccccagacggagtttcgcttatgtcgaccaggctggagtaggagtacaatggggcaatcttggctcaccgcaacctctgcctcctagattcaggcgattctcctgcctcagcctcccgagtagctgggattacaggcgtgcgccaccacacctaattttgggatttttttttttttaagtagagacggagttttatcatgttggtcaggctggtcttgaactcctgacctcaggggatccacccaccctggcctcccaaagtgctgggattacaggcgtgagccaccttgctcagccgttaatatattttttgaagctcagccgcaccccatcacctttgtcctagttaaacctcccctcgcgtgtgagtagttgtgatacagcctgcttcttcctcatctcactgacctgaaacccagcacaccccacggctgctggtggtggtgaagcctcctggtcagcaccagaaactataacaaagttcctcgctttgccgtggtttctttacagtcgcccatccacacctgcacagggaaggcctaggggaaaacacccatggaccccaataaaggcacagcccccaagtcctccctctctcagtcagccgcaccttctgcttgagcctgtgtccctgacagccctgactgctccccgcttcctgctggccccgtaaggtctgctgccctcccgccgcggggtctgtgagtaataaaactgctctgttctggatttcgctgtactgcctccactgtgtctcacctggccgactcacctgaacccagcttctttctccgtcaagactctcctagagatcggccatcctggtaggaataaactgcacacaggtcaggcaagagccacagggtgtctgccagtatcaacaagcttcttgtggaagggaggcctggtcacaggttggacatttaggcagtaggctgtctgccagaatgaagtcgttagtaaaaggcacactgtcaacatccgtgaccaaatgcccaggaatctcatcagggcagggctaaagtttgtagccactctgctgagagagacctccagacgaaatgagaagctacgtgcgcgcacacacacacacacacacacacacacaccccagtctttcagctctctgtgtctcaattcccttatttgtaaaatggggacagatgtgccggctcactgtactgaaagaatgaaatgcagtcatctataaaaagtgcttagagcagtaccaggactcaattaccattgggtgttattattattatatacaaccaaaaacatctagaatatttgactatgcgaaaaactcctaaaattagttttagaagtataaacaatacaatttacaaatgagcaaaaaataaagacaggcaactcacaaaagaaacatgaatagccaataaatagaaaccaaaaattttcaaccacaatgataatcaaagaaatgcaaattaaaatatcagtaagatgccaacctgcatgcatcaggttagaaaacgtatgggataactatggcgatggatacgacaacaccatagtcagacagcctgttgacaggcaggcagtcattcctaccagtgttggtgaatacaaacccatgcattcttttggggggtgaatttggtagaatattataaaatgtaaaatgtaaacactctttcatctaacagctccaatccttgagtctgcactagagaaatactctaaacaggtattgttcatcactgagaaggtaggacagcctctaaatgccctacttacaatactgtaagataattagtagttcatggttcaatgcaacgatgcatatctgtacatattgccaagaaattttcagtcatactgttgttattttttaaattgaagaacaatatataaaaactggtcccatatatattttaaagcccacaataaaaaatagtatataatatagaatttacacatataaacatatgtggcatataaaacatatttatagaacatatgtaaaatcatatgtatcatatgtaaatgaagagcaacagtgatcaattctaaggggaaggcatatgggtaggggattggaggaacagagatttatcaaggttgaattttgtttgctgtgtattgactgaattatttacaataaggatgcattcacttacggattgtgaaattttaaaattaaaaaaaaagacctgacatataggtaatattcagtaaataattgctgttattgtagatgtgaatgtaattattaatcttgaaattatgtattagtctcttgctcttttttttttgagatggagttttgctcttgttgcccaggctggagtgcaatagcatgatctcggctcactgcaaccctcgcctctcgagttcaagtgattctcctgcctcagcctcccaagtagctgagattacaggtgcacaccaccatatccagctaatttttgtatttttagtagagacggggtttcaccatgttggtcaggctggtctcgaactcctgacctcatgtgatccacccgcctcgacctcccaaaatgctgggattacaggcatgaaccaccacgcccagccatctcttgatcttaaggcaccaagagtctgcttttctgacaaccagaatgccactgtactattatttttttttaagctgaagtcttcaaaccagtttcatacaaccaaagcaaagaggaagcctacagagtttcataaagtgaccaggaacagctgtctggattgattcgaaatgaaagaaaagctcgaacttccactgcagcaatcttgtacagcactttacttcggtagacctgacccaagcagcacagagcccggcatttgcaaaggggagtatactttcagacataatgggaaagaagagaattagcattttaagggttgtgtcttttttgctttatttattcatgctttattttcatctttttaaataaatcacattaataggctatatctgtgtagcagacagaaatgtaatttatttgagaaaggcaaaaataaattgccattggtttttaattttgattgttaataagatgatacagttaatactgatttaaaacgcctgcaaacaagctctgcagaattcaaattatttatagataaaacgttaaatattctataacaagcttgtatcacagaaacatcagtaattttgggtctgccttgcagcttatgtcacagaaacctgtctttttttggtgtgtccttcagttattagatataaggtcaacagtctcatgtattatacttaatgcgatggttgtgtccaattcatctctttatcacctaatgataattcttattaatgtaagttatttggaatagatggagtcaggccaatcacaaaatcccttgactgtagttttgaaatatgctcaacatcataatgatggaaagtcatatttggaaactctgagggtatcttcaacttggaagttaacttctttaagtaaattaggattgtccttggcagatggtgaaggacctcactaaatgaaacacataattagttttacactgacataaatatatctccttatgcctgtatttgttcattttaaaaatgagatttgattagatgatctaatcctatctttcagttacaaaagaatgtatatacacatatatgctctcctatagatatcataccatataaaattagaacaattgtaaattatttctaaagaagaaaataaaatataggtctaactctgatgaaatttcagaacagatcatcaaagatgtgttccattagtacttggcaaatgaaaataaaatgatagtaaatgtaataatagtgattagcatgggttgcatgagaaattttatcaaacaatactaatcagtaaatacgacatgccttcgggttgttatcaagatattttttataagaagattgaaaagtttcaataacaaggtcttcttgtggcttgtagaataaaaaggattgattatttgtccattatcaggctgaaagaggatatctgttttcttctgaagtttttgtccatggccccgactcagtgcacactttttttagatcaataacttgaagatatagagagtatcaagtttacaaatcatttaaatcaaagaggcatggctaactgtacatctagtagcaaaaatatgattccaaaagtttaataggctgaaaacatgagattaaaactaaaacagcaagatgggagctggaggcagtggcagacacctgtagtttcagctactctggaggctgagactggaggacagcttgaggccaggagttggagactgcagtgagctatgattacgcctgtgaatagccacagcaccccagcgtggacaacaaagggtgaccctgtctctaacaaaagaaaaggcaaaaactgagcaagatgaaatgtagaaaggataaaataaatagaaaacccaaattaccgatattcgctgtgaataagacatagaagtttatttgttcacagtgagctcaatatgagccagtggtgtgattggttgtgtttcttccttctgaaaatgactgcagtttaaactaaactattagtgttcaacacacacaaaaatatagtggcacttggttagtttatgtctagaaatccatgtttagttctggttaccgtatttaaaatatttggttacctttttagttctggttactatatttaaaagcagattacagacatgcgtagacaaaaggtagttttaaatatggtaatgatattgggaagtgtgtaataggaagccaaatgtttttagcctagaaatgtaaggtgtatgcatttgtgttagggtgcacgcttttagagagggtgactattatgattgggaggggaaataaagagatgccattactatgcaaatatttataggactatgtcttagaaaacacatttgtcttacatttatctttttactctgctttatatttttaatagatgtttaaaaagaaaattaaaattattcttcacagtcaccatttttgaaaagacaaaagtagcaaaaagagagataccagctcatgcaaactaaataaaacaaaagtgttcctgtttctccacgtgtgtccatctttatgtactcagtgtcaaatatactggcaggcagacagcagatgttacatatgtactggccaaatgaatgaataataaatcactatgaagtgaatggcttgtgagagcccagccactaggcaagcctggaggatgaccatctatgagggacctcagagaaagaactgctgaaagaagcccatgggcctccttgacttctaagatacatttagacataatactatttaagagagcaagtaagagcaaattttctcccatagttctgattatcattatagtttaagcgttagaccttgttcaaacaagcttggaaaacaagctgtcttgtctgttaaggggagagtaagtgatataaaaatgtaaaggttaagatttctgataagttaaagcttggtaaaatatttccacgtatgtaaatgattatgccaatttaatttgtttccaaaattggaatatcctttagaatagaaataaaatatttaatctgaatggtaatacactgatctccttttgtcgtgaactaccgagtcctttctacagttttggccatacacatgaaaattaaattacagtattttaaaatagtatttgtatattccatttgggatcctaacttacctaagcagctcgaatacattttaaattaaaatcaagtttggatttttttcccagagaggtgacttattgcaaataagtagctccctctatttcatatttgtccatttttattctaaatattttaatactataacttaaatattctattggttttatttttcttaatatgataatatttttataaagtatttaaagtaaacaaaatgtattatagttattgttagataaaggtgatagacttaaataaactaaggcatgagccatatctggggttcatggatattgaaataatttattcttttaaagcacattattgagatgttacacacatttggaaacacaaagggtaataactttagtttctatcgataataaaaattagataacctgaggaatctttagaagagcatagcaatgtaaaaaaaaaaaagaggctaaaataacacacatacgttttaacagtgtttgtcttttgctggtgggactatgaatgatttttctccccactgtctacatttttacaattaacattattttaacaagaaataaaaatggcgtgttactttcttttaaaaaaaattgttaaatgttaagagtaaaataatggcactacactatttcaaaagcaaaatattaatttcatgttgagcataaaattcttattaaggctgagtctctttgtgtcatactaataaaaaattctccaattatatatcttaagggtacctgggcagagcaaccctcaacatcactaggaaatgaatcccttcttggaactaaattctccaaatcagggaagtcactttcttaagcaataaaatatttggaaaattaaacttatttataaagtctgtttttctactaagtcatttagctcctttattgctttctttatgtggctatttttcaacattctcttaatgattcagagatattcttgtgattgttaaagacttcacaattaaatacgcggcacctgttaggatgtagcgggcactagtgactagcaaagctttggttttgagttacagtgtttgttctttatggaatttctgtattttcccctgtagccttcctgttagatattactgctgttactgtatctttctttaaccacctcttctttcctcgtcttctagcttctggcttttaataaatgtgctatggtaaaaaaaaaaaaaaaaaaagaaagaaaaaagttaatattgcttacagctatgtgtaataatattcagtaattttctcaacaacaaatatcttctatggccaggaatagcataaggccattaagttgctgtgagataggagcagagtgcatctgcaggtgtctgaaggaggagagcagaatgagaatgcactcagagagttcacgcagcccctcgttccctcatttttaggccaggaagtggctcatctggcttatgttttaaatatcattatgattggtctatgccaaatagattttagagaaacaagtggtagaagtaaaatcaggatagaaatgacagaggcttggactagggtagcagtggtggatatgatgagaagcagtataatacaatttctgttttgaaaatgttaatacataaaatcttgtcaactttttaaggggctcaatatgggaaaatgggttatagatacgggtaatggcaagagccactgacaagtttaccagtgacaagatgtgccaaaggtttaggtatgggctgagacacagaaagaaataataaaggacacctcccaggttttggcctgagcaactgcctgaaggtgataccacttactgaggggcccagtaagaaaagcaaacttggctggggaagaactagaaaggaaatcgagagttcagacctgccatgttaaatgtgagatgcagccatacaagtggacgtgatgacaccattctgtagttcaagtgaatgttctggctagagatatccatttgggaattttcacagtagatacagaattaaaacctatgcaattagatattatcaaccagagagcaagtaatgatagagaaaaacaaagtataaggaaaacagtaacttgggcagtgcaatatttagatgtcataaagaggaggaagatccatcaacgcagatagagaacacgctaatgggatagagggaaaaagtaacccaatagtacgtggtgtcctggaagccaaataaaggaggaaaagcagctggactgtgtgatatgctattcagagactgagtaggtcaccactgctttgagttccagaatctgagtctagagggtcgcacataagacttaatatttaacgtatgtaatattagttacatgtattttccacctcctaaatttctcccaagcccacccttctttcagttttcctacctgtacaataaatggcccttattaacccattcactcatactgagtccattataaaaacacaatagtccttaactctgaaatatatttcaaatctactcacttctctccgtctctactgccaacctccttgtgcaaaccatgtttgagaacttttgtaactcattttttgagaactattgtaactgctctttaactaattcctcatcatcccttctttccactcttggcttttataatctaacatgcggagctctcaaggtttgctgccatgttaaaaaaacagtagcagagaaaaccagaaaagaaagcggattctaaggttttggtctgagaactccgtgaatggcaatgccatttattaaaacagggagctctaaggaaggtgagtttgatgagggattgagaaacgtggaaatcatgtgtcttattatgtcatttccatttttttttttttttttttaaggcagagtctcgctctgtcactcaggctggagtgcagtggcgggatctcggctcactgcaagctccacctcccgggttcacgccattctcctgcctcagcttcctcagtagctgggactacaggcgcccgccatcacgcctggctaatttttttgtatttttggtagagatggagtttcaccgtgttagccaggatggtctggatctcctgacctcatgatctgcccgcctcagcctcccaaagtgctgggattacaggtatgagccaccacgcccagcctatcatttccatctctttatcagttctaaaaaattatattcacaatagcataaaaagaataaaatatgagggatattttaacaaaagtagtgcagagcttgcacactgaaaaccataaaacatcgctatgaaaaatcagagaagatctaagtgaacagagagatagtccatgtttatggattcaaagactgagtgttgttaagatggcaaattcttaccaaattgatctatagattcaacacaatccctatcaagaattcagcaggcttttctcatttaaaatttttgcagaaattaacaagctggtgctaacatttatataaaaacacaaaggaatcaaattagccacaataattttgaaaaataaaaatgaatttagactacttacacttcctgaatttgaaatttctataaagatacaataatcaagacagtgtggtactgacataagcatggaaatacagatcaataaagtagagtcaggaatccagaaatagctccttacatataaaatcaactaatttttgacaaagctgtcaaggtacttcagtagggaaaggatagtcttttctacaaatgtgttggaacccctggataaattcatgcaaaaagaggaatttaggctgggcacagtggctcatgcctgtaatcccagcactttgagaggattacttgagcccaggaggaggattacttgagcccaggaggtcaagaccagcctgggcaacatggcgagacctcatctctattaaaaatacagaaatttctgggtgcagtggctcatgcctgtaatctcagcactttgggagtccgaggtgagcggatcacgaggtcaggagttctagaccagcctgaccaacatggtaaaaccctgtctctactaaaaatacaaaaattagctgggcatggtggcaggtgcctataatcccagctactcaggagactgaggcaggagaatcgcttgaacccaggaggcagagattgcagtgagccaagatcgtacctgtgcactccaacctgggtgacacagcgagactccgtcctccccaccaaaaaaaaatattagccaggcatggtggcatgcagttatagtcccaactacttgggaggctgaggtgggaggattgcttgagcctagatggcagaggatgcagtgagccgagattctgccactgcacacactagcctgggagacagagcgagactctgtctcaaaaaaaaaaaaaaagagagagagaaatttacacactttactcatataatacacaaaaactaactctagatagatcatagacttaaacgttagagttaatattataaaacatccagaataaaaacatagaagtattttttgcgaacttgtgttagagaagagttcttagacatgacactgaaagctcaattcatgagtaaacaaaaaaagataaattgttcttcatcaaaattaaaaacttcatcatccaaaatataccattaggaaatgaaaagacaagctacacgctggaaaacatatttgcaaatcatatatttgacaaaggacttgtacccagactatgtaaaaggctcctacagctctattagaagacaactcaattaaaaactgagcataatatttgaatagatattcacttaaaaagatatatcaatggctaacaaacatgaaaatattctccatgccattaattaatcagggaaattcaaattaaaacatgcatgagaaactatttcacaatcagtaaaatggtaatatccaaaaaaataaaagataataataatacaccccctaccacatgaatcagcagttctactcagaggaatctactcaggagaaataacacacatagccacacaaggacttgtatgcaagtgttcataccagtaagaaaaggcaaatcttataggggcacagagtagattaaattaatggttgcctagggctggggaaagagtgtggattaataaaaatggacacaagagatcttttgggagtgaaagaaatgttctaaaactgaattgcattaatagtagcataagtctataagtttatacacattgatttgtacactaaatctcagagaattttatggtgtgaaattataactgaatagtattgttaaaaaatgtaacgttctttctgcacaaataaagtcaattaatccttaataaaggagaaaagcaattcaatagacagaaaaaatagtcttttcaacaaatggtactggaataattggacatgcatatgcaaatataaaaagtaaatatattgaacttacacttttcacaaaaactgactcaaaacagatcttcaacctaaatataaaccaaaatattataaaacttctggaataaacaagaggagaaaaattaatgtgattttgagtttggcaatggatttttagatataacatcaaaagacataatcagtgaaagaataaaaatgtcagttttattaaaatttaaaacttctccacaaaagacactatcaagagaatgaaaagacaagccacagaataggagaatatatttgcaaaacagatatttgatagaggacttatattcaaaatctacaaagaactctaagaaactcttaaaactcaacagtaagaaaacaacacaattcaaaactgggcaaaagaactggaaaaagaccaggctgtcaaagatacagagacagcaaacgagcatgtgaggagatgctcagtgtcgcgcgtcatcagggaaatttgattgaaaacagcatgctgataccattatacactcattagaatggttaaaatcaaagaaactcacattaccaaattcctatgaggatacagaccaacaggaactctcattttttgtgggaatgaaaaatggtatagcagctttagaagacaacttggcaaactcttacaaaactaaacataatcttactatacaatccagtaatctcatccatatttgatttgaaaacttatatctacacaaaaacatgtatgaatgtttaagcagctttatatataattgccaaaattgaaaggaaccaagaagtccttctataggtgaatgcataagctagtagatccatataatggaatattattcagtggttaaaaaaaagtgcaatcaagtcacaaagacaaggaggaaactgaaatgcacgttggtaagtgaaaaaagccagtgtgagaggctacatatgatatgatccaattatatgacttgtaaaatgaaaacctgccatctatgaaaacacaaatcctgattgctaggaagtgaagtcagaggggatcaagcactgggcttggggcgatggtgaaaccatcctgtgtgatgctgtaatggtggatgcacgacattatgcatctctgaaaactcatcaaacttcacagcatcaagagtgagccttaaggtatgcacaatttaaaaaataggaggctgggaatcccagaaagatatgcagaatatgacagaggaatgcgactgtatcataaatatatcaaattacctcactgaatagggtcaggagaaaggggctgacctaaataactttggaattgagcaaagtttctaaaaattaaagaacagcaactgcacgtaagcactgtactgtagctggcaaagttgtctcccatgggaatacagcttcacgattcttagccctccccttacttctctgtaaattctcagtctaactgtaagaacctggcttctctcacccaccatcgtttatgtagctgttcagtgatatgacacctttatacaactattcgaatggctgaaatataagcaactcacgtgaccaatgcttatgaggatacagagcaaagggagctctcattcatttttggtgggaacaaaaaagatacagccactttagagtttggcaaactcatacaaagctaaacatgaataggtatataaatgaaggtgggttggaaaagccaggttattttttggttagaatttacagataagagaaggaggctagaatgatgcctttgttagcatatttgaattggagacatcagtataagctcacatttagcttaatatagatacagatggccacctatggaaatatttatagatgtatgtatatacatgcgttaggatacacacatctatttctttgctctatcagctgagaagatctaaaacaaatggcaccctcgtatcaatgaacacacctagatcttgcattgactacctcctccaataaaacaaaccaagtcttcttgtagagagggctgatactaacaccaaggccaggtgtatacaggatgagcctggagcatccagtagtcacagaaagcagggcgtgcaccctcctccccacagaaaacctcacatcatgagggtgtgtgaagggggcacaaagccaactgaaagcgctcccaatggccaaagctggaacgatttgagccacaaaataagtcgtgttggattataatccaaactataaaagaaatatccatggcctggtgcagtggctcacacctgtaatcccaccactttggaaggccaagatgggtggattacaaggtcaggagatcgacaccatcttggccaacatggtgaaaccccatttctactaaaatacaaaaataagctgggcgtggcggcgcgtgcctgtaatcccagctactcaggaggctgaggcaggagaatcgcttgaacccaagagacagaagttgcagtgagcccagatagcaccactgcactacagcctggcaacagagcaagaccctgtctcaaaaaaaaaaaaaaaaatccacgagtctacactgatataaagaatgattgaataaatgaataaatcggggagtcaaatcaaatcccctgccaaatcatttctaataacttatgccactgttttgcctttaaggaagctactccagccttgagggattggagcataactcctaatccctaagtgtgagctacacatacagactcccttccaaggggtagattctggaaagtgcagggcgaggcagcggaggagccactttacagggaagaaaacacgacctcagccaggtgattcaagtcgaagtcagaaccaacagtcacaaatcatgctgacagtgcttgcccacgatatgatgcaatgaaaatggcggcttagctttgtgattttcctctacaaaagacacaaatctagtctaatcatgaggggaaaaaaagtcagaaaatttccaacagagggcaacctacaaaagaggacttctcaaaattgttggggtcatcaaaaacacaggaagtctgagaaactatgacagccaagaggagcctgaggagtcacggccactaaatgtaacatggtgtcccataggattccggaacctaaagctgatgttgggtagaaactaaggaagtctgggccaggcacagtggctcactcctgtaatcccagcactgtgggaggccaaggctggtggatcacctgaggtcaggagttcgagaccagcctggccaacatggtgaaaccccttctctgctaaaaatacaaaaattagccaggtgtagtggtgcatgcctgtaatcccagttactcaggaggctgaggcaggagaatctcttgaacctgggaggtggaggttgcagtgagccaagatcatgccactgcactccagcctggggaactgagtgcgactaagttaaaaacaaaaaaaacctaaggaagtctgaataagctatgggcttcagttcataagatatttataatattagttcattaattatgcaaaggtaccatgctaatataagctgttaatgatagtgggaactggcttgggtgtatgggaactatctgtaccatcttcctaatttttttatgaacctaaaactgttctaaaaactaaagtcagagtcgatgtttctatcagtatccccactctccagccatgtctttgtgttcctcttcctcgcagtgcatgtgaggatttgctccttggcctggaacactgtttctcttgctgtggatcaacataagcctaatccatttaatcatggcgatctcatcatcagctcccacctaaactgctcctcttcacagaagagttttgctgccttcaatctactccattgcactctcactactccctcgagtttttcttcacaggacaagccatatttgtattatctgagtgttattaattagttaaagtctatcacctccagagactataagctccatgaaagcaaggactacatttgctcccaatttcaatactgagagtaacattgaatattcgatcattttaatgaatgaatacacgacagaaaaaatgaatcctgacctctcaaagattatgtacttatttttacttccttcttggcagcatgtaagattacatatattctaaattattgatagtgaacttctgtctaacccacgtggtattctaaaagacattttaactattcagatacagctgaatatttgtatcagggtaatacaggcataaatatccagtggttaaacctccatgaatgtacaatattttagtccatattttacatagtcattaaatgctttattgaagcagagtaaagtctgaaaactaaagccaaatcctttgacactaaaaataaaaaaaaagcgggtgtccaagcaacataacggtcagtgatttgctacttaacaaatgaaaaacaaagaaacaaaatccaaatcaatgtaaacaatatatacctctctgttgacaatgacaacaggtgctatcaacacagaagatgatataaatgtaagtgctttagtcaacattacagccagatgataataagaacatttcactctgcatttataggacccagtagcagtcggctgttaaagaaaagtaacaataatcaaactgggctaagtattttctatgtgaaggtatcatgaaatttatgaagtctgtgtaagaaagataaaggcattcacttttgaaagaataagatagtttaaacctcaacattctctatgcttaaaattgagctaatttgaataaacagaccatgacatggaactgtcactttacaagttcctgctttagtctttaactctcaaactagcattctttaaactgtctaacactgtgaactagttttaatgcctccagctttgtctcctattattatgagcacattatatggagtgaaaaaagaggaatattgttggacttaatagtaaatataatatggaaaataatgcaatgagcacttaaacaaagttataaccatggttaaacaaaagaaagattgtatgtgtcagctgctgaaagacattctaagttatttgtgtgcaatatactgttgtttgacagaactgacacctaaatgtgaatgatggtttgctttcgctaatattagggcatgaatctaggtttaatccagtccagtcaaacctggactatgcctcactttttcttcatagatttgacaatgggtcttcattttaaaatcacttacaaccacgaagagaaaaaaaaaatctcttcactggtccgtttggcaaatgacagtttgcttgagatttccttctgagatcaaagaggaggaaataatgtcacgctgcaggaatttctaatgattaatgttattaccatgaacaccaaaggaagtgataataatttgccaagtgtgctgcccggttttccagtattaactcatcactatttgcttcctcagagtaaggatttctcacaaataaggaaaagggatgaggagatatgtattgcttttgttttccgagaatgccacgcacccacactcagcacaccctagcgagattttagcctatgcatgtgcgtctttcctgcctttgcctgtttctgcctcttgaccagcgtctatcaactatggagctcgactccctgccattaaggagacagacttcctggggtgctctgctcccacctgctcccttttggactaaacaatgtgtgtgctcttctgttacagagtcagttccttccacaaaattaccgtcttgctgtcattggtatggctgccagcaaaccatgccaaggtcttctggtgtgcctacagctaaatacttgaggagaaagaggggaactttgaagctcttgatgccacactcagcatggaacaattttggcaaagcaaccatttgaaatttgcttactcttcaatttagggacggctctgatgatttatgagttcagtgagttgaattcaaagatagaaaagagcatgtttctcctggacaattatggagaaagggagaattagctgttccttattcttcttgttagttaagtcctatttgaactgttcttgcctcatgtgatgggaatgtctaaaaatgccaaaggagccatccatttatttccagaattagcaaaaaccacaaacttcgctgctgaagagcaggctcccacaggaactcatataattctgcagcgtgccattgactttaaatggccccaaatactttcttaaaactctctgatgtgatctatctttgtggtaaccttccacacaaagtgctggaacagtgagaaatagaaatatacatgcttcataatgacttgctagtttaaaatgagtgctttgcacatggcattgggcatatccaggccctctcttgcttgggcataaagccagtctgaaaagtgaatgtataaatcattcagctagatatgtcagcttttagatgtatacgcttcagcttagaggcctaaaatatatcacactgttttcagagttttgtagcttattatcggagcaatagagaaagattttgattgtagaatcagtgtgtctaagtgcatagtatggggcaaatgtgggtatctaatgagttaattcaaaatcataagcagaggcgctattcttgcttcttagtaataaagtgttcctattggagtcatcaatgataatacaactttagtctaaagcaaggatggaatcaaggaattttatttatagtactgtaacctgttaatttgatgggcaaagactgacaaattcaggaatgaaaagaatgtgcttttctttccctttcctctcctctcctcccctcccctctcctctcctctcctcccctctcctctcctcccctcccctctcctctcctcctctcctctcctctcctcccctctcctctccttccctcccctctcctctcctcccctcccctctcctctcctcctctcctctcctcccctcccctctcccccccttcctcccctcccttctcctctcctcccctcccctctcctcctcccctcccctctgctctcctcccctctcctcccctcctctcctctgccctcccctacccttctctcccttccttctcttcttcctcccttccttcctttatccctctctccttcccaccctcttctcttcctcccttccttccttctgtataaagtaagatagaggtaataaactcagtagattcagtataccgatagcatataacactgacaaatcaggtaccagaggcaagttctgcagtagaatctacaagtgaaacttctagaattgtattattaaaccataaaacatgcatccctcccaccctaaagctattttttcttaccacttagatgtaaatcatctgaaataaagttacagattttgagtaacaatattagtatgtgaatatgtgttgctgcttctctaagaacctcctagtatacccagtacacctgttggtaagcccctgtcaacagacagagctggtcatccccagccacttcacaggagttcctgccgtttacagtatttcttcagaagttacgttcaacaattctgctacttatggttttctttttctgtaaatttactaggcaagtcatctctgcctgacttgcaaattcaatgcttgactctcagattactactgctttcatatagatgtggatcttcctttgcaatggttttttttttttttttgaggctggaattcaaacgtattattgaacctctagaataaattaatatttcttttcagggttactatcgatgagactatatctaacatgtctgcctgagtaatttgttttctataattatggattactaaagggtagaatcaaaatatttctgaggttctcatacagtataatgtctagaattcaaaacttttttgttaagtgaaaagacagactgtcttattcaaaaggtgcacattcgctttaataaatgttgacaaagattctgtctttgaaatttagccaggcttctctgagcccattcttaccctggccttggcctcggtctatacagacatgtttgtagtggcctccaaacactaagttcgtttctcacagttgaaagctgcatccccagggacgaccccgaccccggctcggcttcagtgcctgcctgaggacactgcaggctgcccaaggagtctactgtttgctccagccaacccctggagagagggctcccatctcctagcctctgtgggagggtaagggcctcatcttgacaagctccagttaacaaaacaatgtgggtttcacacggaccaatccccgatttcctgctttttgtaattttccacttctctgaccagactgatcccccgtcacccatgctctcttctctcgctcttgctttaaaatgcccagtctcctctgcacaaataaaacttgagttcaattcatgctggactttttcctactacgatggtacgttatggattaaaaaacctgtccttccagctttacctaatggcaggctttgtttctctttggaccatgtgcatggtgtatctttcttctctgctctcagtgtgccagaagtaaaattaagggattgaaccaatggctagaacatctccaaaattcttactcactctgggtatggtctgctatttttgcatttaaaaaaaataacttttactttagacacagggactacatgtgcagatttgttacatgagtatattacacccaggtggtgagcatagtacccaataggcggtttttcagcccttgcctgctctctccctaccacctctagtagtctgcagtgtctccatttttcccatgtttatgtccatatgtggttaatgtttagttcccactggtaagtgagaacatgatgtatttggttttctgtttctgcattaattcaattaggattacggattccagctacatccatgttgctgtgaaggacataattttaccctttttatggctgcatagtgttccatagtgtatatgtaccacatttgctttaaccagtccaccactgatggtcaccttaggttgatttcatgtctttgctatcgtgaacagtgctgcaatgaacatacgcgtgcatatatctttttggtacaataatctattttcctttggatatacacacagtaatgggtttgctgggtcaaatgctaattctgttttaagttttttgagaaatcttcaaacggctttccacaatggctgagctaatttacattcccaccagcagtgtataagcgtccccttttctccgtagcctgaccagcatctgttgtttttttaccttttaataatagccattcctctgatatgatatggtatctcactgaggttttgatttgcatttctctgatgataatgatgttgagcattttttcatgtttgttgcccacgtgtatatcttctttcaagaaatgtctgctcatgtcctttgcccatttttaatggggtcgttcacccttcgcttgttgatttgtttgagtttcttataattctggatattagacctttgttggatgcagagtttgcaaatattttgtaattcccaggctaatcatattatacaaacccaggtctgttagcctgagctgcagtttgagataaataccagtaggtggcagtgcaggtcacatggtggcttattctgcacaaagctgctttcccatgggggtatgcccttgggaagagaggactcaggcaccagtctggacaagcacccttttgttaacgcaaaggaaataagtcaatcaaatcaacaccagtaaagaaaagtatacttagaaataccaaacaacaatattaaaagaaaaacatccttaagagtactgttttcttttctcctcatactatttttgagtttacattgctgctgcattttatgaactctttttgcattgcagccccaggttcaaggcttggtggagtcctgtagtagccacccaagatttcactggtcttcagaaacttggaaataatctctcacaattcgtcttaaaaccactgaatgtatggttcttatggaggagaggctggctaaaggcaaagtaaatgtagatttcgtgtctcatcacagaggttcagcaatcactcgccctgtcctcagtagttccccaatagtcccctcccaggtccccactcactgcctctgggatgcatcccccactccctccccactcccctggggtctgaacaataaatggaaagcaactcggcctcttccctttcaaggtgggcaccgccactctagtttagtgaaaaatctttccctaaaatggtcagattgataaaaggtaggcaacggttcaggaatatttgtgcttccattagtgagatttatgaacttactccaacattctgaaacaatgggggttgatgatacagttccctaaggttctttttataaatttagctccaagatctttatttatctgtaacttctgtgcttctcctgagcctgtggtaacacacacctcttaagcaagggctgctcaattaagaacaccctaggaggcttgcacctgaaggtttggctttatgccagataccatatctgcactaaagagcttgtcttactaaaggggctcactcccattcttttccattttaacaaaggttaacttaacttaaacataaaatatttgaaataattctatagtgactgtcccatagagagagaggaaatgtatttacattgggagctctatggaaatttcataaagtgaatagttctaaaatgaaaagacagaaatctctagcataggttatatgttccagtgttatgaattaagtctcaaagaaattaagttcttcaaaaaagttcctgttataatgacacatgctgaactctttgtgtgtgtgtgtgtgtgtgtgtgtgtgtgtgtgtttgtggggcctctaataccctcatgttttcagtttatattttacagtatccccatttttcagttgaagaatcataaggagatgctttaaatagtttgcccaagaacatcaagtgagtaatttgaccaagccagaaaaattgcaacaaaagctgggtttctgcattgcatcagccagaaccgtgctttctcagaactctaattcagtattataatatttctgctctaacaccttgcagtggggaaaaaattaaaatctgatattatacacacactttggaatcctttaaagtaaatgaaatatttatgattcaacctgggttcaaatgaaggaagtgtaggcatatcagctacagtaaaccaattgatgactcaagatggccaatgatgataaagttgagagtcagctggattttcactggggctggcagcaagacaggcctgatgttgaaaaaagcagacacaacaggtggaagaacggcagagtggctcttgcttttggtctgaacactcccactggctgcagcactgagttctatagaagcatctgctcacctttcctcttggctggaaagacttacatcaaatgattacaggtttaatgagggagaagtgtcaagattagaaagactaagctgtaggtttcatctggtaaacaatacgggaaagaggctgggcacactggctcacgcttataatcccagcactttgggaggccagggtaggagggtcacctgaggccaggagttcaagaccagcctgggcaacacagaaagaccctcatcttgacaaaaaaaaaaaaaaaaaaaaaaaaaacagctggacatggtggcatacacctctattcccagctacttgagaggctgaggcaggacgatcacttgatcccaggagtttgaggctacagtgagccatgagtgcactattgcactccagcctgggtggcagactgagacactgtacagaaaaaaaaaaaagaaaaaaagaaaaaagaaaagaaaaaggaagatatttactcttgcaaagaatatgggaataaaggctatttttaaagatatgtgtgcatttttattttatcttaaacaaagctctctttttacagacctattcaaaaacactgtattatctacatttaaggtttctgaattgttcttgaaaaaggtaagcttagactggtaattgtggctcatgactgtaatcctagcactttgggaggcccaggtgagaggactgcttgaggccaggaattcaagaccagcctggacaacatagtgagatcccacctctacaaaaaaatttaaaaaattagccgggcatggtggcacacgcctgtagtcccagctacagaagaggttgaggcgagaggataacttgagtccaagagttcgtagctgcagtgagctatgatcatgccattgccctccagcctgagtgacagagcaagactctatctctaatgcaaatgaaagccacaatgagataccatctcacaccagttagaatggcgatcattaaaaagtcaggaaacaaccgatgctggagaggatgtggaaaaataggaatgcttttacactgttggtgggagtgtaaatcagttcaaccattgtggaagacagtgtggtgattcctcaaggatctaaaaccagaaataccatttgacacagccatcccattactgggtatatacccaaaggattataaatcattctactggtcgggggcggtggttcacgcctgtaattccagcactttgggagggcgaggtgggcggatcacgaggtcagaagatcaagaccagcctggttaacatggtgaaaccccgtctctactaaaaatacaaaaagtgagccaggtgtggtggctggcacctgtagtcccagctactctggaggctgaggcaggagaatagcatgaacacaggaggcagagctcgcagtgagctgagatcgcgccactgcactccatccagcctgggtgacagagcaagactctgtctcaaaaataaataaataaataaataaataaataaataaataaataattctactataaagacacatgaacacatacgtttactgcagcactattcacaatagcaaagacttggaaccaacccaaatgcccatcaatgatagactggataaagaaaatgtggcacgtatacaccatggaatactatgcagctataaaaaaggatgagttcatgtcctttgcagggacatggatgaagctggaaaccatcattctcagcaaactaacacaggaacagaaaatcaaacaccgcttgttcacactcataagtgggagctgaacaatgagaacacgtggacacagggaggggaacatcatacattggggcctattgggggttggggggttaggggagggagagcattaggagaaatacctaatgtagatgacgggttgatgggtgtatcaaaccaccatggcacgtgtatatatctatgtaacaaacctgcaccttccacatgtatcccagaacttaaagtataataataattttaaaaagactctatctgtaaagaaaaaaaagaaagaaaaagaaaaaggtaaccttgtctgaaaatcttatttatttgtatgagattttcatactatactcaaatattcatccaaacatttgatttaaaaaaaccctctttctcagttttcagttacgtttaaacaagttaggcaaagttactaaatcatgatacaatgaagatcgtattacattttaaaattgctaaaatataaaaaagaacactatatatcttatttttgttacaaactcataatagatcaaactctataatatttagatttgtgacttctttgcatttaagtttgcaaaattccataaaaatacatcccacaattttgtttctagtcttatttcactgaaacaaatttaaacgatttttatgtagattagcaaaataaatgcgatttttatttcagctggaagttgggattattttttgtgagctggaagaagtgataatttactaatcactatactaaggggtcacttttgcaaagaaaatatttcttttacaccccattttaaaaatattattgttttgttgtatatgtaagttttctttggttattatatgtctactcatcttaacagtttttgctttacttatgaataagaatgataaagatcactgtatgcgtaacagctgaactgttgctcattttcctattgaatataacacgaaggaagagtttctaaagcattggaggaagcaggaaggagttgttctaacaaagtgatcatattcacaacgaggaactgttaaaactactgccaaagttcctaactgacatgaaaatctgatggagtcctgggggtagtaattttccctgtgagctctcttcaagaagtccctaaggaaagaatattgcaaaatcagaagttgaagagaaacatacagaaatattcaggttgtgtcttccatgcagaacatatcaaatagctaagagtctgcttaataaaagagaatcagaacaggtagattggaagaaaatctaacaaaagtcgatttgactttttgtttgtttgtttgtttgttttgagacggagtcttgctctgttgcccaggctggagtgcactggcacaatctcagctcactgcaatctccgcctcccgggttcacgccattctcctgcctcagcctcacgagtagctgggactacaggcacctgccaccacacccggctaatattttatatttttagtagagtcggggtttcaccgtgttagccaggatggtctcaatctcctgacctccgcctgcctcggcctcccaaagtgaagccccttggcactgcgcccgaccatttgactttttaaagtgttttaatttaacaacaatgtgtagctggctatatattggtaagggaaattagtgaagtcaaatttgtagttgaggagatcttttcttctgcatttccgcacattgctgtgtaaacatgagtgcaggtgaccgctggtaattctctattggaaacttggtgtcttcattctccatcctccacgtggctccgaagccctgctctgcctcaggtccctgtgtgtccaggccctctatggtcatattctctcacctacacttgggccaatgacatgaacagaattttgacagtttcacaaagcactttcaccttgtgggtgggttcagtttatttccttacaggaggatattaatattgcaggttctaaggcgagaggagctttgtgataagttaagaaataaggaatgaagagaggcaggggaaaagacttctgtgtgaaaatagaagaggcccattttaagcacataattttccttatttcaaagggaatacgcaggcaggttactgtagcagagtcacaaacaagccaatgtgacttaaaagtatgagtcatggggaaatggagtgacacgagatcagctccagggatcacgccttcactttgcctgccttggggactcagagatctgcttgcgggtttcctgactcctacgtgaggtgtcagtgaaagcagcagtgatgttaactttgaggaaatttggttattgtgacaggatagataaatgaaccgtatcggggtttcttcattttcgtaactgtggtgctaatgaggtattcagtatctgtggttgactgatttattccccaccagaaaagatgcttgggctgcagatttcacatttagaaaaaaacatgatcctttggaaaagttgccaccaattactcagtctccagtttcagtccatccacggaatgatctgtctatacctctgtaatgtactgcggccccagtcagccacttggcagctttgcaatcccatgacctttttaaatcctgaaaataaataaaattgtaacattcttgccttgttagctcttaaattttcaaatttctatgtgccaagttgttctgcttaataaatcaccaaggaggtattgtcatgatggattcgtattttatttttattttcagtattgtatgcagtttacttaaaaaagatttgtgaaaaaaagagatagcacttttagctattgctaaatgagatcaggaaattgtcttccaaataggcaagcacaaagctgaaaaaaaatgaacaaaatcatccatttccatactgtagaaattgagcaaaggcttaacacaaatttgagaggcacggatgcttaaaaactgtcgaacttctgggaaaaacgtgggaactatgtcactctggcctgggctgcccaccttgtccagggtgggacgaactgtagagggttttctgctgctggaagggcctctgtggctttggggagacggcagcgccagggcccgcggggcggcaggagggactgggaggcccacagcggtcccgtgggaaagctctgtagggacgggcaggagtgaacatgttgtgttttgtgggctacaaacaggctctatttcctctctgcctcctcctcctgctttttcttccacttttttttaacatttgtttttaaatggaaagtagtttttagctcacaggtcatacaaaagctggcaaacggctggcttcgaaccgtcctggcttcgaaccgtggctgccatgtgcctcccgctgctctactcgcctgaggttgaccctggtaagcggttgccgcctgcagacacggcgcatgcgagggagggtgcaggccgagactccgccccgaagggcgcggcgtgcccgagagatgcgagcgttgaggaaacggaaatccagcgcacacgtgaaaacgccccggactgcggctgcgccgcttacccgcacacagacggttggcagaggaagaaagccttgtcacactaaaggagagacagcggatgttctgaacagtcctgtcgtgaaacgttagacaacgtggacgaaacaggcacattcctaagcatcacacattactgaaactcagtcaagaagaaatagaaaatctgaatacatccatggcaagcacagaaactgaactaggggattcgaaatcttcccacaaagaaaagcctaggcccaactggcctctatggtaagttctatcaaatagtcacagaagaaatcatggcagttcatcacttactgttgatgtttcagaagatagtggactaaggaacaatcccaaatcattttacaaggctagtagtaccctgatagcaaagccaaagatatcacaagaggaaaaacatcacagaccagtatctctcattaacatggttgcaaaattccttaacaaagtattaaaaaagtgaatccagcaaaatataaaaatgattatatactatgacccgatggggtttatccaagaatgctgggttcatttgacatccaaaaaccaatttaatgtaatataccaatcacattcaatttataaaggactaaaatactccgtgattatctcaacagatgtaggaaaataattggacggcatgtaagacctatttatgatttaaaaaaaaaatcttaaaaaactggaaatagaacaaacgctttttaaactgacaaaaagaatttaggaaaacactacaggtaacatcatatctaatggcaaaagactgaaaatccccccttaagaacagtagaaagatgtctacttttattatttgtattcacaattatactggattttctagccattccaagaaaacaaccaaccaatcaatcaatcaactaattaaatgtatccaaagtggaaataaaggagtaaaactgtctttatttaaaaagaaaatgattctatatggagagaatcccaaaaaatccattaaaaaaatctagaactcatcaatgagtttaggaaggccttgggatacaagatcaatatataaaaatcaattgcatttttatatactagaaatacaaaaacacaaaaattaaatgaagaaaatttcattcacacatatgaaaatgtaaactttttggaaattaacaaaagaagatgacatctattgaaaactacaaaatgttgctgagagaaattaaatatgtacataaatagacatttcatattgatggattagaagactcaagatggaaattctctccaaattagtttagaaattcaacacaattcaaaagcccagcaggcttttttttgcaaaaattcataagctgatgctaaaacttatctgcatattccgacaacctgttaaaaacaaaatactgttaaaaacaaagaactacttgatttcaaaaattttgttaaagccacagtaatcaagacaacgtggtgctggcacaagcttagacgcatgcacatcaatggaaaataattgagtccagaaacaaattcctgcctttatggaaaatttacttttcacaaatgttctaaaacaactcaatggggaaactatagggctttcaataaaagcctgcccacacacacacacacacaacaacgtctacccctaacccaccaaacctgtgactatgttaccttaaacatggcaaaggagagtttgcagtgtgattaacggtatagatctagagatgggggggatcatcctggattatctgggggcagaggggccagtctagtgacttgagtcctcaagagaggaagggaaaggcagaagggtgggttaaaaagactcactatgagaagtacttcatccttcatttctagctttgaagatgcaagtggggaccatgagccaagcagtgtgacaggctctaagaagctgggaatgtctgtcagctgacagtcaataagaatttgaggaccttcttcttgcacccacagtaaattcatttctgccaacaaactgaatgagattgtcccctagagcctccagaaaggaacacagcttactgtcatgtttattttagtttggtgaaacccaacccagactttccatctatggacctataattaaaatagtttgggggcattcttagtccacaaatttagtccaaatttaataacaaatttgtgttactttaagcccctgagtttatgattaattcattaagatagcaatagaaatctaatacacaatgggatgaaaaagaaattaaagaattataaaaggatttatgtgaaccatgttaaggaagattatttaaaactaggaaaaaaggcaaaaaaagatgagtagtatgtcctttcaatgtcatattggaacactttatcaatttcaaacaaggattatttaatttcctataataatgcatttttacgttttgctaattggatttgattgacagctcaagttttaggaagtaacatgttaacttgacaggtttcatttcagtagaaaagatatttccaaaagttatggtttcattgccctgtagggtattagccagttttgtactaacctagcaaccctatgacaaaggtctatttttaaaatacctgtaaagactgtgtacttcacagactcttggaaatgctttatattctacctagtttgctcactcttgagctaacaagtctttggtgtatattaattttatgaatcatacttttaacttttttaaagcattatagctggacaaccataatgtattacttttaagaattctggataattttgagacatgccaaattagacccatcagtaaaaaacaagatttaataaatagaaaaataatgaatgaccatatgaataaatagatacagaataaacaaatggtacataaaggttgacaagaaaaagccttgatgattctggaatgttacataataatataggaatcaacttaggctgtcattttcaatatcttcattgctatcaatttatgagggattttgttagcattaatgtgatatacaatggaaatttgaggaaaaaaatgacattgttttaggtgaaaatggaaaatttaacaggaatataaggaaaaaaaatactcctgggaaacagtatttcccatacttaaagcaagaagacattctggtgaccaataggctcacatgctagttttgagagaatttgtgtggaaattgatcagtaaattttttctaaatgtcctagagactttaggtgatactttggatgatgacaggatttttaaattataatatttctgtagctacttctctttttaaagaaaaagatagcaatttttttctatctcctgggtagaattttgtagtttaacacatctctatagccaagagttcatttttttccctcagatcagatccttatgcctgtatctctagctctgatagaacttatgtttcattttaattatatattattacattgtccctcaaatgatggacaatgcattttcctgttaaattttaaaattgccttaattatgtagttgagggccaaggtactttacatacatcacaattataccagagagaaccatgatgcaatagagtgcaattgtgagagctagagtattgcctcattctgctactaaatttaaaatagtctgggggcactcagtccaaaaatttggctcccgtttcccactgttcctaactcagtttcttgtctcattttgtattctctgaccaaagttattcaggctaaatcagtattaggaaacaaagattagcaagtgaattgtacttttaattattcaatatgcttgtctgtaaaataaagctgaacaatggccgacttcaattcgtggttttaaaataagtggctaaggaaaagccaaactgctatgtggatttttttttcctctacccaagtttgtatcaatcccaggcactatcgtagctaccaatctggcacacgtgacacactttggggctgagatcagcattttacataaattttcaacccagccatccaacttgaaagacagaaacttccatctccagagtggttttatcacccatgaggaaagctggccccagagaagttaggccccttgggtctatggtcacacaagctgacattcagacccagttctgcctgaacccgccggctctgtccttcccattaaaatgagggaattgggaaacctgagttctggagctgctttgtgacttagagtcaatcatgttacctctctagatctttgtttctccaacaataagagaatatgacaaggctaagtcaggttgaacatctcttccaaacttaaacgcagatatgacacatagtgcagtgtttactatataaccatgttgtgcttatcctttgaggaaaaataatagaaattctagggccaaacttttcaactttttggcctgggtgacttgttttcctccttaaaaaatccatatcacagagccacctgcttccacagttaccatattaaaatcatcctaggattttaccactgatcttcatacatgtgtatttggactgagtcacattttgttgtaaaaataaatgatgtcagataaaacattgtgtttaaaataagtggtattaataatctctttaaaatgcatgcccatgaaacattaagttgtctgaaagaaatataatctgctttcaatatattttctcatttaagttgagcgttcatgtgttcaattcaccctaaatacaaaataattcttactttcctaagaatttttcatgaaagcatgttaggtaactggtaatgccaaaatgaaactaaggcactaagtaatagattatgataaaaagaaagaattcatgctgagggaaaaaaagaaaaagatgagattggacttaaaataagttacatggacccatttggagctgagtctaacaaaatatgatttatgtgcaaagcattttttgttacataatttatgaagcaaaaacgtggaacatagcatatggtgagttgatttggaagaggggatttaagcataatcattcagcctggggtttatgccgtgtttgaatatctgtcatacctctgcctggctcccatccccacatgtgacctcctgcatggtgagacttacatcacatcccacacactttctggactgttttgattattcactgttaaccttaaaaagtatggcttcctgttaggcacttttatttcatacaacataagttgtatgcagtgtgcttcaaataagtaaacaaccggcaggtcagaatagcttttatttatttgttttgtaaatcccagctttctctgggtcctcataaagaggagtaatagagaaatagtttctggccactctgctttattatttcagacatgcatggcctcctatataatttgcttattgatttcaataataaagaccaggaaattacatcctctcttgtctgtggagctatgaatcacagattgcttaaccactgtcaaattaaacaacttgcctgtgactgagaaaggattcatataaagactaaaatgatcatcagcctcccactaatccagtgtgtcccccatgttaaatgaagtcagcatcactctgggcagctgtgctgcctcctttgaggaaatcagcctccttctcaatcatttgtactgccacacagtttgaatcccggattctggaagattatgccagatacctttctctcctgggagataactgctcaaaaacaaagacacaattaaaataaaaattagacatgagcacagtggctcatgcctataatcccagtgctttgggagacggagtcaggagaatcgcttgaggccaagagtgtgagacaagcctgggcaacatagaggatcccaatctgtacaaaataaaaaaattaaaagaattagctaggcgtggaggctcatgtttgtagtcccagctacctgggaggctgaagcaggaggatcacttgagtccaaaagcttgaggcagtgagctatattcatgccactgcactctagtttgggccacagagtgagattctgtttctacaataagaataaaaataaaaataaaataataataataaaaataaaatcaaacaaaacattgaaagaactctggtttctgattatctaaaagctcccaactgataccggaaatactgttttctaatgctaacatttgaatacccaaggtctctcatagatttattgcatcaaatctctgggttaaatttagaatgaggttgatcttcaggagcagattctcattctaaatcacacaattgtatctagaggctgagtgtttaaagggacaagaccaacagtgggctctgggtgcccagccgagcaacctctagaagtgttttgctttttcagaaagcaatgaaggggcttaaaatcatttgtgaaaatgatttaaatgatttaagggttgaaagcaaaaaacaaacaaacaaacaaaaaaacctcatctgggcccagtattctcattataggtagaataatgatagaaattgcaatgcacaattttactgcaaattttgcttgaaagcagacaaatcatcttggaaaagtagatttgactccctgcactttagtttccttatctaagcctgagggtttgatgatgtcttcgatgtttttaggagttctaactgtatatattttaatgccaaaataatctttgtggccaatcttaattctacaatttgaaaatagttttaagttaaagattttaatgcgcttggataacctgcaaatttacatttaaacctgtttatgtaattattcactcacatttaaatgtggtaacttctgcccatgtgatcttaaattaaaacattctttgaagctagatgaatacttagcatgttaataacatctgatgagacccagatgaaagctggtatgaagtacttcttggtcaagaagttctctctctttgttaatgtaaattttataagtttccattacccaatgaacaaggtatataaattggatgagttcttcttttttgaattatcgtcaggttatacaaagaggaaaggtggaacattaaaaagaatgaaaattcaaaggacttgaatcattggtctgttagtaaatttgcaattttataaaccgcaatgatttataaactattcaaaacattaatatttacaagcaaaattatgcaaagcatacacaacttttgctgtcttgattagactgcatcttttgtctccaggtaaaaataacttttaaagttattttcaaaaaatatttattttttgatgcttaatttttagttgcctagtgaaatgattgctattcatatctaaaaggaaaacgaacctcaggtggtatgtcacagtgagatgtcattaagttattattaaaaatggcttatatgcaatttaaagccagcttccacgaatgactcttgtggtgaacaagaaaccaatatagattatttgtagaaataaatattccttgattcctagactcctataaaaccacctgaataatattgtgcactgactgtggaaggattttgataaaatgtacgtttttcatgtcagaatgaatgaattatgtgcatgatataaagcaatagctcccaaatttcccacaaaggacatcttttgttatcactgttttttttttttcatcagtatcagtggtttaaaagatatttttctattaccacgagatagccagcagtaccatattggctttctacaaggcatttttaggttgtgaggtgcttctgaggctaaagatatattacatttggctttttgaaatagtgaaatataaatctctaatagtctgagaagttgaaattgggaattactagtgtaaagaaaataacttataaacaaggcccttgattcaagtcttttccatgactttggttaactttatctattaaaaaaaaaactaggcaatttttaagtttcccttttaatgctaacatttcatattgtgttttcagcatcccacttgatgaaaattcctgttataataaattagccccttgaggttcctggaaaagcatgaagacttgatatcacctccttcctcccactctccatgtatacaaacactccaattgatactttctcttatattattatttaaactattttctttctgactctgcgttctatcttctgtcttgactttattcacccaagatgaccaaaaagacaaagatttgagctatgaggtaggtgtatgatacataggggaaaaacacatacatatataggttatatgaatatatgtatatctccatatatatatgttatatacccataaaatatgtaccaaattgctccttcaagctatatattagaccataaacacaattaaagtataaaacaaaatgaaaatataataaaggtttttaatatcaatgactggtataaaggcattcataaatagcattttaaagaaaaatacatttaaaataattaaaatataaaataaaaaagtattttgaaacattatctttaatgtttatagcctaaaatatattttttaaataaataaagtacctacattaaaaggtctaagttttttttaacaaaataaacacaggtctaaagaaaaaaggaaaacataaatgtataaaagagaatgtagcaaaataggaaataacaaagaggatcagtaaatataaaagttatttaccttccccccccaaaaaaatgaataaaatatacaagtctttaagccaacttttacagggaggtgctgtggtttgagtatatgtgtcctcccaaaattcatctgttaaaacttaatccccaatgtgataatatcaagagctgtggcctttgggaggtaattacgtcatgagggctccatgtttatgaatggaataacacttttaataagtatccttacttattaaagaaacttaagaggaactctttgcccttctaccatgtaaagatacagcaagaaggtgccatctatgaaggagaagacaagccctcaccagacaccaaatctgctgatgctttgatcttggacttcccagcctccagaactgtgagcaagaaatttctatttctatttcacccagtccaaggtattttgtaatagtagcctgagcaaactaagacaggaagaaaaaaagtatatatagctgtatcagaaattaaaaggggacataactacggtagaatatatacttatatatatatttatatatattttgacaatatatcaaaaatttaagttaatgcatttgaagaagataaaattaatacctttctgaaaatataattttaaagtattccttaaattacaaaatttaaatacaattatagaaattgaatcagtaatttaaattgccacaccccaagttaccacagatgtaattttgcagatgcattttagaaaactttaagataaaaacttttcattttcccttttttatttcaaagaatagaaaaatgttcctcttccattcgtggctaagcaaattcttattgaaccaacccttccacagatagcaactctaaacaaaatgttgaaaaagcaactacctgcaggcactggagagtgaaaataatgtgggagacactggagggaagttatgaataagataacagtagggtgtgactctccacttgttaactgcttttagaatgagagcagtctgcaggtgttgccacacaaagcaactaaaattcatatggaaacccatggacttactgacttgaaaggccaggggcaaagactcgggcaactgcagctgttggtaagtgaaggagcatattacaaagaagaaaggacaatcacagggaaacaattttgcataaaaagcagtctgaatctctagacttcaaaaggccaactaaggttttacccacacaggggagatagaatcagaagttcaagttcagctactgcttaacattttttcaataagaatgaaaatccttcagagtaacataatttagaatttagagtctctacaatgtatcacagtgttcaacaatcttatattacttggtatacaacagaacagaaaataataaacgttctcaagaagaaagaatgtcagagactaaccctgagaccatccagataaagattttgaagtagccattataactgtgcgcaaggatagcaaggaatagattgttaaaacaaatataagatagaaaatctcagcagagaagttaaaactattacaaatgaaaattagaaaactaaaatatatctgaaataaaaattttgctggatgagtttatcagcaaaatagagaagacagaagaattagtgaacttgatgactcctcaatataaaatatccaacctgaataagaaggaagacgattcagaaaaataaataatagaacctcagagaactgtgggacaatatcaaaatgtcaagtgtgtgtgtgtgtgtctctcagaggagaaaaaagagacaataaagcagaaaaaaattttgaagaaataatgtctgaaattacacaattgtgatggaagacataatttacagattcaagaaactcagtgaaccctaacaggataaagttatacatatgtacatactcatgcacacacacagaggccttaatacatcatagacagactactaaaaaccaaagataaagagaacatctagaaaaaagacagaggaaaatgataaattccatataagtgaataatgatttgaataacctcaggcttctcatcagaaatagtgagagccagaaaaaaaaaaaaaacaacttttttaaaatactagaagaaaaaaaatgtcaaccaagaattctatattcaatgaaaatatcctttaagaatgtagataaaatgaagacattttcagaaaaatgaaataaactaatctctactataagaaatgctagagggagttcttcaggctaagataaaactataaagaaacatgaatctactggaagaaataagatgtattgcatttacatgtgttacaatccctgtaatattttaaaattagtattatagggattatagcacatgcaaatacagtacatatgacaactagagaatcaaaactgagggtgtggtgaagtgatcatgcacttgcaggatttgtacactgtatacaaagtggtttagtattaactgtgtaaactatgaggaggtaaagattcattgtaattataggaacaaccactaaaaaagaaaatagctacaaaaataaaaaaattaagtaaaagaaaataaaattcctaaaaaatttatatattccaaaagaatgccaaaaaggagaaagagaagtacaaaaacaaagagacaaatgcaactcataataggaaaatgatagatataaatccaactatatcaagaattacattagatcatcaatcactccaattataaggcagaaatttttgtaagaaataaaaaagcaagattcaactatatgctatctacaagagaaacatattaaaaataaagaaatagaaaggttttggttgacagtaagtatacctaccatgcaaatagtacacataagaaggttggagtgtttatggtaaaatcatatagatttcaagataaggaatattaacagataaaaatgatgaaagttttgtcaggaagacaaaacaatcattaaagtatatttatcaaaggatagaagagaatgaaaaactactcatatccttaaaaagattataaactatactgaaactagtcaattttaagataagaaataagatgacaatctcacatagtatatatacaaaaattttcaataagctatcagcaaattaaaattgtcattataataaaaaattatagcaagaagtgttcatctcagaaatataaagataatacatcacaaaacataatacaacacatttacatattctttttttttttttttttggggacagagtctccctctgtcgcccaggttggagtgtagtggcgtgatctcggctcactgcaagtttcgcctcccaggttcacgccattctcctgcctcagcctcctgagtagctgggactacaggcacctgccaccacgccccactaattttttgtatttttagtagagacgaggtttcaccatgttagccagcaaggtctcaatctaaacaaaatagtatgtttataatggcaaaattaattttaaaaatttaatactgactcatcaagaaaaataacaacaaaagaggccattttcaaagcaggaagagaaaggattttttttccccgagtaagagtttctagtaaaaactttaacatacatcagacttaatggtgacaggttagaaaaagtattcccattaaacatatgaataagaaccaagatgtctgcaatgttccattatgttagacattacattggaggtatgtgtaaagataaagattttatgaggagatattccaaagacagatttgtgattctttggatgtggcactgttgaaggtgaatctaaaagcttttatggagcaatgtcaaatttgtgagccacacggagatggagatgagattataatacacttttatatgtactatcatagatgtaaaactctctatcttaatattaactttgaaaatgttaaattgagaatcctgttaacttacattttatgaattggcatattgtattactgcaagatatatttgattttcagcataatgccaaaacaaaagattttttaaaaaactataaaaatgcatatatttttctaaatttattttgtcttaaagcacactttaaatgtcatttctcattgagcaaaattgtcaaatttctatggaaaattttaagataaaaagaaataggcaaagaattggaaagagacaaaattgacaatatttatatccaatttaatattctaagtatataatccaagaaaccatacagataagttactaaaacttgtaagaagatttgatatagttgccagattactatataattgaataattatatagaaaataagtagcattctaagtgcctttaataatttaagaaggacttctgcttatagccacaacaaaatagccagaactggattaactgtcccagctaaaatcactaaaaaataatcaaaatatatgtttttaaacacagtttcagactttggacaacatgtagcccaggacagtgatccctgagaaaaggaagacaaatgaggtgacactgtgatagacccagatcaacgcctggaaaaagtttcaaagctacaatgtgaggagtggggacaaaacagtctagtggctttgctgagtggagaaggcaagtactggagtccaggcaaagtattggtgaaggtggagccctggagaaaaagaactctagagatctgtaagaggctctccttgaaacttctactgagcacagttctgcacatgcatgtatagaatttactcaagatgaagaaagaaccaacgaaaaaaagcatagtataatgctgagaactcataaaatcgagtaggaaatcttgcctattgaaagagcattgagacagagtcctcagaaggaattttctcagtggtgggaacaaattagctataaacccaagtttgctctgatattgctataacaaagcttaaaagcaactctcaaaaggctcaaactgagtacaaaacatctaattgtaacccagggtacttcccaacagtattcaagggaataaaatattttgtgtatattttgtattacaggaatatattgtattcctttatatagcatattgtatttctttatatatgaaatgatatatcatcctaatttagagcatgaagttacagatgtatattataaactctagaacaaccactaacactattttagaaagctataaatgataagcaaatagagataaaatagaatgataaaatataatcaatccagaatatgggaagaaaaagaaaaagggagcaaaaaaaaatgaaaaaaatgaaacaaattgcaagatgacagatttaaacctaatcatattataaccacattatatataaataggctatatactccaattacaaaacaaagattgttgaataaaaaagtaagacccaactacatactttcagcaagaaacccacttcagatataaagacataaattcagtaaaactcataagtcaatgtcataaatacatatatataatatgctcgcactaattaaaagaaagctggaatgactgcattaatatcagaaaatgtagatttcagagcaaagaatagtaccagggataaagaggctgaattcacatattataggggtaaaatatttgagagaacataagattagtctatgtgtatatctgatagcccagcttcaatatatatgaaagaaaaattagtggaactgagtggctagatatacatatctacaattgtatttgcaaagttcaacaacttattcttaatcattaatagatcaagtagagaaagtaaggatttacaagaattgaaaacatcaccaaccatcttgacatttatcgagcaactccacccaacaagagcaggaggtatattcttttcaatttcccatggaacattgaataagatagatcataaaacaggtctcagtaaatgcaaaaacattaaaaccacacaaaagaacggtccatgtccacaaatgaattaaattagaaatcaatagcagaatattttaaatattcatccatattttcaaaccaaacaatatacttctaaataactcatgggtcataaaagaaatgacgaggcaagtcagaaagtattttgaactgagtggtaatgaagcactacacatcaaaatctgagggacagagataggtaatgtttagagaaaaaatcataaaattaaatgctcatattagaataaaaagtttgtcaaatcaatcattttgaagcctgcatcttaagaaatgttcagtcttcaagatggtggaatagaacctttcagcagttgtcatcaatgtgaacaactatccacacttgaagacacctttgcaagcattaaggaatccaggtgagagactatgacacctgagtgtagtatggaactaagaaatgcactgaagagagtggaaggacagtttcacatgacccatgtcacccttttccatgcccaggcagcacagcacagagatgccctctgggtgggaaagtagagtgatgtcaccacctgactttgtgtggagcccagcaccaggtacaccccagagaaacccagtgctgggctgattccagcagccccaggatccagattagcctctgtagatataggctgcaggcttgcccggcatcaagctggcccctgttgccccagactctcggctggttgcaatggccacatgttcccagctgacccagtccccaggcccatgtcagtgccagagacctagccactgcggacctagccttcaggccagcatccacagatgcagtctcttggccaggctccatgtacccaggctctatgctagccccatagtctcatgtactaggccagcactcatggacacaggcttgagactggcccctgcagacccaggttcccaggcctgtcccaggaccaagacagcccaagctccatgtcagtccccacatccacaggcttcagtggacccaaggtccagtcttgctccagtagattcagagtgcaggctcacctcaaagtcagcagaaggaaggaaataataaatatcagagcagaaataaatgaaatagatagtttaaaaatcagtgtaaatatcaatgaaactaagagatggttttttgaaaagataactaaaattggcaagtccttagctaaagaaagagaaaagactcaaacaactaaaataagaaatgaaagaggaagtattacaactgacaccacagaaatacaaaggattataagagaatacattagccattagccatataacagcctgagccattatacattgccaacaaattggataacacaaaagaaatggataaattcctagaatcatacaacccaccaaggatgattcatgaagaaatagaaaatctaaatagagcaataatgagtaaagagattgaatcagtgatcaaaatatctctcaacaacaacaacaaaaagctcaggtcctgattacttcactggtaaattctagcaaacatttaaggaagaattaatatcaattcttctcaaactctcccaaaaacttgaggggaaagaaatgctatcaaattcaatttacaaaatcagcgttattctaatataaaagccagacagggacactgcaggaaaagaaaattacagaccaatatccctgatgaacatagatgcaaaaatccttaagaaatactagaaatccaaattcagcagcacattacaaagaccattcatttaggtgagatttacccttggatgcaaagatggatcaccatatacaatcaataaatgtgatatactgcattaaccatatgaaagataaaaatcatatggtcatcttaatatatgcagaaaaatcttttgaaaaacatcagcatcttttcatcataaaaactcttaacaaattaggtatagaaagattatacttcaacattatagagatcatgtatgacaagcccacagctaacatactcaatggtgaaaaaggtgaaaaactaaaaatttttcccccaagatagggaacagaacaagggtacatactctcactacatctattcagtatagtacaggaagtcctagccagagtaattaggcaagaaaaagaaataaaaggcatctaaattgaaaagcaagaattataactgtctgtttctgcagatgacattttttatatagagaaaatccctgaagactccccccaaaaactgttagaactaataaacaaattcagtaaagttgcaggatataaaatggacataaaaaatcagtagtaatttatatactaataacaaactatctgaaaaagaaattttaaaaaagatctcatttacaatagcatcaaaaagaataaaatacttaggcatacatttaaccaaggaggtgaaagatctgtatgctgaaaactataaaactttgattcaagaggctgaagaaaacacagataaatgggaagatatcccatttttatggattcgaattgatagtgttaaaatgtccataccaactaaagcaatctacatattcaatgcaacccctatcaaaattccagtggcattttcctcagaaatagaaaaaaaattctaaaatttgtgtgaaaccacaaaaaaaagtcaaagcaacatggaccaagaagaacaaagctggaggcatcacaatacctgatttcaaaagatactacaaagctatagtaactcaaacatcatggtactggataaaaacagacatgtagaacaatgaaacaaaatatagagtccagaaataaatccatgcattttggtcaattaatcttcaacaaagatgccaaaagcatgcaataggaaaaggacagtctctttgatgaatggtgatgggaaaccggatatcatatgcagaagaataaaattggactcatcttacaccatatacaaaatcaactcacaatagattaaaccttaaacttaagacctgaatctttaaatttattagaagaaacaataggaaaaaagcttcttgacatagaactggccaaagatttttttgatatgacctcaaaacacaggcaataaaagcaaacctaaacaaatgggattacatcatactgaagagcttcagcacagctagggcaacagtcaacagagtgaagagacagcctatagaacaggagacaatatttgcaaacatacatctgataaaggattaatatccaaaacatacaaggaactcaaataactcaatagcaagaaaacaaatcactggattaaaaaaaaaatgaacaaaatatttgaactgacatttctcaaaaaaagacaaagggccaataacaatgtgaaaaaaatgcttattatcactaatcatcaggcaaatgcaaattaaaatcacaatgagataataacagcttatatttgtattctgtatatataggccaaacattgtttcaaaagctttatgtaaattaagccatgtaatccctacaacattccaatgaggtaagtgatattactaccattttatagagaagttaaataatttgctgaaattcaaacagcaaatcagttgacagtcaggattttattctaggaagattggtagtcatttcacaaaagagaaaacagaaatggccagtaaacttaaatatatactgtctcaaaaataatatgagaaatacaaaaagtgctgttacaccatgtgctagcaatgatactaagaaatgaaaatgcttacacatggctggtgtgaaaatacattaagatgacaagaaacatagcaaaatgcaataaatttgaacatgatatattttcatccaagcaattttactccaagaagacaagaataaaaacatattgtagcgtttttaacttgtaacaaaatactgcaaataatctaagcaccctggactggacaagtaaatggacaaaaaaaaaaaaacaaaaaaaacaaaactcatggcatattcataaaatggagtaatgtgctaatagagataatatatgaacttgcagtacctgtaccatttcagatatgctcaacaatatactcaagttaaaaacacataaggttgcagaatgatgctaattttgtaaaactaggaaatctcaaagcttattctactgattgattctgaaacaggaagtaaaagtataagaaacattcgtgagaataacagacatcaaaccaaggaatgtggctccctctgaacagggcagatgggaatctctattagagaaaagtcacagtacacttcttcttcatgcactaatgggttgggatttgaggttttaagataataggacttgattctacttgaaggatgaaaattttcttccaataagatgactttaccctatttcttgtgaagtgatctttcttgatctgctttgtattttaaaccaggctcacacccctttattaactgaagctgacttaacccgaactatctgaagctgactcaacccgaactatccgagatcacacgtaaatgttttccttctgatctcaacttttctccttatcgtggggcatggaaaggaggagatcgcagcagggaagtttttgttcttgttcacatgctaacaatggtaagcttcttaaaagtgaatcacagtagcatcacagagtttggacaggtgatgtaactaggagctacgaaaattgagtgccataaaagaatcatctttaaatactgaagtgcttctgtatgcttgaattatacagcatttcctgtttcaaagcagtttcacacaatctcatttaacacttttaaagtcatagtagttgaaccgagtatatcgcacccctgttacggctttttcttgattataggacaaaatgaaaagaacttttatgatctggctccaattatactttcaaggttcaagtcttcccatccggtaagatttttcttctttacaaaatgccccaactgaggcactcatgtactaggcacaggagactacctgtttgaaatatcccttgcttctgctggaaatgctgttcccacactgaactcatgtgccaactctcagctcaaaagtgcatgtttgtctctaccagtggactaaggaccagctcctaggatgggagcagtttcttactcatgtttataaagtgctatgcagaaaatagcagggctatgggaaagaaagagaccaggttagaaaagtcatttgaatcggatctgcatgaaaaaaggcactttagataagacctgatagcaaagggctgtaagaggagaaaagggcaaatcaaaggtaccgacagaacatattaagcatggcctaggctgagcaaagccaaatttaaacataattttgtatgttgaagcacattattttccaatatgttaatgtgtagccattctcacatacataataaagctaatggattatttattcaattgtatgttttgttataggagcctctgtcattaaaaagaaaatttattttcgtatctgggaaaagttgccaaggcaaaaaacacacacctggccatgcatctttagtttgttattgtttttaggtttatttgaaacttacaaagtgaaaaaaatcaatgacttctcagaaaaaggaaaaaaatagatgtaggtggaagagaaagaatacataggattataataggtttggcgaggatctcatgttgctgaagaaaacgagtcttgggattctttgtagtgggtcttcagaacaggcaaagaaatggttacgagtgaggataccagaaggagaagaaaactagaaatttgaatagaaagttgaacaaaatgaactttggataccaataaccttcagtgaatgggtgaagaagaaaaaacctttctctagttctgtttcaaaggcagtaatgaatagaatagcaaaagttaagcatgaatgaaatccatatttatctattttttgaaaggtaatgcatgtcttattttcactgcattatttccagagcataataatttcagcctaagttaactttcaatggtcagtctttgctgtccagcactgcattgctcaggagattcattaatcaatcaatcgatcaatcaatcagttccttctgtttctttcccacctggagctctgctgtcagagttgcacatgtgagtgagatgtagctcacttaggaatccatgcctgcagctaccctgggagctgactgccagtctctgctcagaggcccttgttcccacaggcatttgctctctgctgtgtaatttatagtttaagtcaaatgattccaaacacagtctctaacatttgggtaaaatctgtctagtactttcttgtgacacagaaacatagagggaaaatattgctatatttatgcaaatatagaatctttactctgaggcttttcttaaattcacagtcacccatatgccaagtggatttactgttcattactcagtgtctttactgtttgtaactcagatcacgttttccttcacaaagcctgcttactgaatatttgtgtgatgatttgaactcaattagctacttattgctaggttatattttcccctttgcagcaagcatgtcaaagattatacatttttttaacagattgcttttaattgtattagttgaagagcagtctttatatgtaaaatagtgaattatagttaagggaccaagggccattgtgtcttaagttttaattgttcaatagatcacctaatagtttttaaaatttttataggaatgtctgatcttatccacaaactttaacaaatgggcataaaaatattcctcccttaatttttctgacctgcactttttctgttttgtttttgtattttttattttgttggttactccacgtcattggttacttcatgtcaggattatttgcagcaatcttctgtccttaatatattgatgttttgggggcttctaacctaagctctattctttttccattctttaaattctccaagtaatcatacattcagttggctttgattactatgtatattaataattctggccaggcgtgttggctcacacctgtaatcccagcactttgggaggctgaggtgggtggatcacgaggtcaggagttcgagaccagcctggccaaaatggtgaaaccctgtctctactaaaaaatacaaaaattagctgggcacgatggcgggcgcctgtaatcccagctactcgggaggctgaggcaggagaatcgcttcaacccggcaggcggaggttgcagtgaaccgagatcacaccactgcactccagcctgggtgacacagcaagactccatctcaaaaaaacaataataataataataataataattccaacaccccatctctatgtccacccatttcttttctaaacttcaggctcaactgcttgttcaagctctccattgtttacctcacaggaatctcaaggtaacttgttcaacttgagtgtctctggacctcccctctctactggcttctctgcaaacgtttttcttggtgagtgcatctgctttcccagctgctcaaaccagatttctagggctctccctttgctgtttcccatccgacactccccatcctggaaatcacatagctttgtcaatttcatcactagaaacaccagcccctgcccttctgtcctaccggcatcactgtacagcatgctactctcatctcttgtagcctcattgcagtttacctccctgtttctaactgggccctgctccaatccactttccacactgtatccaagggatctttgtaaaattctaatctgattgtgccattcccttgttaataccaatcaataaattcccaaagttcttaagtaaatctaggtaagttgtttataaattccttcatgttatcatctccatttacttttttatcctcgtttctacccaaccaaaacacctttaagtgcaacagtcccacagttctaaattacattcattttttatggtatgctatttctcactttcagcatttctatttgctgttgattctgcccagaatgccgtggacagtcccctctccttgcctctcatgctcatttttaaccagcttctactcatctttatttttcatatatcgtctcagatatcacttcttctgagacacaatctttagggcctcaaagctgatctaggtgtccctcttatgtactttaatttcttgatcacatcaaatatagtactgaaatattatttttcagtgatgcttaacactggttctatttttctttttcttttttaatacttggaaaactttcactaactaacttactatcattgagtttcttgactggggtcccatactttttttaaaggtggatattagatttggaataacctcatgggtgattccaatacatctttggggcaacatctctgactatacattgagaaacactacttattgcaattcttgtttatttatttatattctacattagcctgtaagctagctctatcagggttgtgcctctatttaaaaatcttactgctgtatcccccgtacttatcaggcactttgcaagtaacaggaattcaacagatgatggagtcattgaatgaacagcttttgtcaatgaatgaaatgttcaggagcactttctttctttctttctttctttttttgacggagtcttgctctgttgctaggctggagtgcagtggcacaatcttggctcactgcaatttccacctcccaagttcaaactattctcctgcctcagcctcctgagtagttgggactacaggtgcatgccaccacacccagctaatttttgtatttttagtagagatggggtttcgccatgttggccaggatggtcttgatctcttgacctcatgatccgcctgccttggccccccaaagtgctgggattacagacgtgagccacagtgctcagctgagaaggagcactttcaagggaaggaaaataaccctagaaatgtcagatttgtgtctacataattaatttctactgttattccaggaatgtgaccaaaatttattagatctgtgcttaagaacagtaaagaacttaaaaattatcaaaagccttaaaatgtgcatacagcaattctaattctgggaatttatactggcaaaacataaaaattagcattagtatttaattaccttgagtttttataatggtaaaaattgtgaatgacctaaatgatcaataatagaggattgatttatgaacttatggtatatttatacaataaactataatttagacattaaatcatatttttaaatgttatgtgtatttttttaaaaactttaagtatattgaaggtttattacataggtaaactcacgacacaggggtttggtatacagataatttaatcgcccaggtactaagccttgtagccaatagttatttttcttaatcccctccgtcctccctcctccctctcttcaccctcaagtaggccccagtgtatgttgttcccctcttcttgtctatgtattctcatcatctagtgcccacttgtaagtgagaacatgtggcatttggttttctgtttctgtgttagtttgctagggatagtggcctccagctccatccatgtttcagcaaaggacatgattgtgctcccttttgtgattgcatagtattccatcgtgtatatgtaccactttttttattcaatctgccattgattccacgtctttgctattgtgaatagtgctgcaatgaacaaacacatccatgtatctttatggtaggataatttatattcctttgggtatatacccaataatgatattgctgggtcaaatggttgttctctttttagctctttgaggaagtgccacactgctttccgcaatggttgaactaatttacattcccaccaatggtataaaagtgttcctttttctccacaacctcaacagcatctgttattttttgacttttagcaatagccattctgactggtgtgagatggtatcacattgttgtttgaatttgtacttctctaatgatcagtgatactgagctttttttcatatgctttttggctgcatgtatgtcttcttttgaaaagtgtctgttcacgtcctttgctcacttttgatgggattgttttctttcttgtaaatttgtttaggtgtcttatagattatgaatattaggcctttaacaggtgcatactttgcaaatattttctcccatcctgcaggctgtttactctattgatagtttttctgtgcagaagatcttaagtttaattagatcccatttgtcaatttttgcttttgctgtaattgcttttggtgtcttcatcatgaaacttttgccatctcctacgaccagaatggttttgcctaggttgtctttcagagttttgacagttttgggttttacatttaagtcttcaatcatcttaagttgatttttgtacatggtataaggaaggggtccaatttcaatcttctgcatattgctagccagttatcccagcaccatttattaaatagggaatcctttccccattgcttgttttttgcagctttgtcaaagatcagatagttgtaggtgtgtggccttatttctgggttctctattctgttccattggtttatgtgtctgtttttgtactagtaccatactatttgggttactgtagctctgtagtctagtttaaagtggggtaacatgattccttttttgtaatagttttagcaggaatagtaccagttcttgtctgtacatctggtagaattcagctgtgaatccatctggtcctgggctttttttggttggtaggatatttattattgtaaaatcatattttagaagtgtatctactgatatgcatttaataatatataatagacaaaaaagattaccaaaaactacacacataatttcatttgttaaatttatattttatacatttaatatattatataagaaacagtgttcactgatatgtacaatcatattcataatttttatcaccctagcataagataattttgtatattctctttctgttttttggttttagtaattattatttttttactctgaaagtgtgtttcacaaattacaaaatgttcctaaatattaaagtatgtggaaactaaagagaagtatttgctcaaatttttactgaaatcttcttcatccatcacttcccactaacccagtgtttttctcaggaggcccacacaattgcctattatcaagaaaagatactttcaaaaaaactgaagggagcggttatatgctgtggcacagcaatttcaatataagttgtggatatttcccaaagaatagtgtcttgttcatggaaatgcactcttgcttaatcagatgatgacctgggatatggtgttaactagattaaaaaaaaggccatctgtgcctgaggctcttctggtaggaaaaacttggagcttaaattgttttcattactagaatttgcatgacagtggtttttagtaacatacaaagaaaaacatggtacttaaaaatactatcaaaatacttttcttactttaaaagaaaaaagttctacttttttttttttttttttttttttttttttgagacggagtctccctctatagcccaggctggagtgcagtggcgcgatctcggctcactgcaagctctgcctcccggattcatgccattctcctgcctcagcctcccgagtagctgggactacaggcacccgccactgcccccagctaattttttgtatttttagtagagacggtgtttcactgtgatctcgatctcctgaactcgtgatccgcccgcctcggcctcccaaagtgttgggattacaggcgtgagccactgcacccggccaaaaagtactattagatagtgttactaaatattaaaaggaacattgtaagaattcttacacatcttatagtgtgaggaaaatatcctcttattcttaattgtgttattttagacttactgcctttacattttaaacctttcctgacacttttttttattatgaatacattagtgttatgtactttaccaaaattattgctttagggtaaaaacactattgaatagtttagactaaggaattttgaaggctcattagttttgttcatataaattgcctatgaaattagggattcctgaaaggatagtggtatcttttgagtcaattgtgttgtcagaaataataataataataataataacttcacaagcccatgcttcggatcctagctctgcagccattctgtgacctcacaggcgttggaccctacagtcactgctatagaagtcacatctgcatcacagaccttagagcaatggttgctccacacaaacccacattctggaccccggttccataacagctctacatgtgccagtgcctacaacacaagagccactactgctttagaagcacccatgccctggaccatacagaaactataggtatccacatgcctttgtttcagaccctggctttccagctgttccataagcatctgttcattgcacattgagaccaacactggagccggggtgcctgcatgttaagcaccagtgccactgccaccatgaacataaccatgaaccaaacccaacaccaagagggatccccttggccatgacttcccacacgggagaacaagaaatcaggagggctcctaccaccttcaccaactcttaacccaacagccctcaccaccactgtggacatctgcagccttggccactgaggacccttgcaatcttcaacggatggaaatacacagagactatgcttttgtatcttcactggagctggaattgctgcatcccacccatcagtaccctcataccacctgtaggtgaaggactttcctcacagaaagtagcctgtaaattctggaataggtgactgccccagcaaatatgcagacatcaatgcaagacaagaaaagcagaaaacatcaagaaaacatgacactaccaaaggaaaaccataatttccagtagccagtcttccataatggagatctacaaattgtcacagaaagatttcaaaataaatgccttaagaaagctcaagctacaagcagactcaatgatatcaagaaaacaatacatgaaaaaaatggggtaaataaagagatataaataattttcaaaaacaataaaacaaattctgaagctgatgaatacaatgaatgaaatgaaaaaaatacaacagtgacaaagcagacttgatcaagcagaaaaaaaatttgcgagctcaaagacaggtaatttgaaattacccagttaaaggaagaaaaagaaaaaaagagtgaaaatgagtgcagaaagcctataggatttatgagataccatcaagcagcccaatttacacattatgataatgtaaggagaagagagagaaaaagaaataatatttaaagaaatagtggctgaaaattcctgaaatctgaggaaatatatatacatcaggatacattaagcgcaaaatttcccaaacaaatttaactcaaagaggtctccactgaggcacattataataaaatttttaagtatcaaagaaagagagattttgaaagcatcaagagaaaagagactcttcacataaaggggaaatttcattagactacagatgatttcttagcagaaacttttcaggccagaagaataggctgataaatcctaagtgctaaaataagaagagaaaaactaccaaacaagaatactttactgagccaatctgtccttaagaaatgaagaagagataaagactttcccagaccaaaaaacaaacaaacaaacaaaaaacaaatgagggagtctgttaccacaagacctgccttacaagaaagttctccatgctgaaatgaaaagactttagtaagatgaaaatataagaaaatataaaaatcattagtaaaaataaatacatagtcaaattgaaaatattcaaatactataatagtgataggtaaatcactcttaactgtggtataatggttaaaagacaaaagtattttttaaaactatagttaatttttcaataaacatacataataaaaatatgtaaactgtgagatcaagaaacataaaatatatttagggggagtggaggaaagaaagggcagagtttttgtatgtgattaaggttaacttgttattagtataaaatagactgttataaatctaatgtgttttgtgttagcctcctggtaattgcacaggaaaaacctatagtagatacagataagataaagagtaaggaatcatcagatatcactacagaaaatcaataacaaaggaagtgtacaagagaggaagaaagaagcaaaagaactacaaaagagacagacacaattgaaaaaaggcaatagtaagtccatgcctatcaatacttactttaaatataaatggattaaattattcaatcagaagacatagagtggataaaaataaacaaatgtgcacatatgcacacacccacacaaaccaaactatatgctgcctacaagagactcacctcagctttaatgacatttataggtcaaaagtgaagggatggaaatggaaatggaaaccaaaacaatggagaggttgctatacttacatcagacaatacagactataagtccaaaactgccacaagagacaaagaaggtcattatagacagacaaaagaatcaacaaatccagagtatataacaattgtaaatacatacgcacacaacattgaggcacctacatatataacataaatattaccagaactaaatggagaaatacacaacactacaacaaatagtaggtaaattcaacaccttcactttcaacaatgaacatactttccagaaacaaaattaataaacacattggatttgaactacactcagaccaactgtcctaacagacatatgcagaacactccatccaacagtaactaaatacacatttttttcaagtgcacattaaacatcctccaggacagatcatagttgaggcaaaaaaaaaaaaaaaaaaaaataggccatagcacaggtaaaaaaattgaaatcatatcaagtatttttccaaccacatgatatgaaactagaaatcaacaataagagaaaaactaaaaatttacaaatatgtgaaaattaaacaacacactcctaaacaacaaatgagtcaaagaagacatcaaaagggaaataaaaagattgtaaaacaaataaaagtaaaacataccaaaacttatgggatgcagcataagcagtacaggaagtttacagtaataaacacctatattaagaaaaaagaaacatctcaaataaataacccaactttacaccttaagaaattagaaagaacaatctatacttaaaatcagcagaagaaaagaaataataaagatcagagcagaaataaatagatacttaaaaaacaatgtaaaggatcatggctaggcacactgactcatgcctgtaatcccagcactttgggaggctgaggtgggtggaggtcaggagttcgtgactaacctgactaacatggagaaacccaatttctactaaaaatacaaaattagccaggcgtgtggtgcatgcctgtaatcccagctacttgggaggttgaggtaggagaatcacttgaacctggaaggcagaggttgtgttgagccgagtttgcaccattgcactccagcttgggcaacaagagagaaactctgctcaaaaaaagaaaaaaaagtgtaaaggattaagaaaactaatacatgttttttgaaaaatttaaaaaattaacaaactttcatttaaattaactgagaaagaaagagagaagacccaaataaataaaagtacacattaaagaggaggcctttaaatgatatcacaaagacacaaattactgaaagagactattatgaacaattatataccaacaaatttgataagctagatgaatttgggtaaatttctagaaacacaaaacctaccaaaactgaatcatgaagaaatagaaaacttggacagactaataataactaaggaaatttaaccaataataaaaaatcgctcaccaaagaaaaacccaggacctgataaaatttactatttggtagacctcactgttgaattcaacagtgaattctactgaacatttaaggagaattaatgtaagtcactttcaaattcatccaaaaaattgaaagataaagaaaattttaaactaaggctaatattaaggtattaaggctaatattaccttaataccaaagccagataaagacacgaaaatataaaattacaggccaatatccctgaggaacacagaggcaaaaatccttaacaaaatattagcaacctgaatttaacagcattaaaaggatcacatacctttatcaagtggtatttatctctgagatgcaaggatggttcaacataccaaaatcaataagtgtgatacacattaaccatatgaaaagtagaaatcatatgattatcttatagatgcagaaaaagtatttaacacaattcaacattgtttcatgataaaagctctcaacaaattggatatagaagaaatgtatctcaacataacacagtttatatgtaacaagctccaaaataaccgtatactcaggagtgaaaaggtggaagtttttcctcaatgatcaagaacaaggttgcccactctcaccacttcaacttaacatagtactagaaggcttagttagggcaattaggcaagaaaacagaaaaaaaaaaaggcatctaaattagaaaggaagatgtaaaatagtctcctgttgcaaatgatatgatctatatatagataatcctgaagactccaccaaaaacactgttaggactaagaaacaatttcattaaggtttcaggatacaaaagcaacatacaagaggtagtaatatttctatacactaactgaaactgcttgaaaaataattttttaaattccatttaaaatagcatcaaaaataatatatttggaaataaatttaaacaagaaggtgaaagatctgtacactgaaaactataaaactttgataaaggaaattgaagaagatgcaaataaataaaaagatattccgtgttcatgatttggaaaaattgatgttgttaaaatatctacactatccaaagcaatctatagactcattgcgttccataccagaatttcaatgacatttttcacagaaatagaaaaacgattctaaaatttttatggaaccacaaaagacccctaatagctaaagcaatcttgagcaagaagaacaaacctggaggtattacactttctgatttccaattatgttacaaagatatagtaatcaaaacagtatggtattgggataaaaattagacatatagatcaatggagcagaatagagagcttagaaataaacccacacatatgtggtcaactaattttccacaaaggtgtccagaaaaaacaatgaagaaaatacagtgttttcaataaattatgttaggaaaactggacatccacatgcaaaagaatgaaattagacacttatcctacaccatatagaaaaatcaactcaaaatggagtaaataattaaacttaagacccaaacccttcaacttctaacagaaaatacaagggaaaaactccttgatattggttctggctatatatgtattttttggttacaacccaaaagtttcaggcaacaaaagcaaatataataagtggtactacaaaacactgaaacatgtttacacagcaaagaaaacaatccagaaaatgaaaaggtgacctacagaatgggggaaaatagttacaaaccaattatctaataaggggttcatattcaacatatgcgatagcccctcaacccccatccatagtttcactttccatggtttcagttacccatggttaactgcagtctgaaaatattaaatgggaaattctcaaaataaacagtttataagttttaaattagcatgatgaaatctcactctgacctgctccattctgtctgggatgtgaatcatctttttgtccaacatatccatgctgtatatgatattcatcttttaatcatccacatggcctgctcctgacatccaaccagtaacattatcatggctcaaagatcaggaacacccacagcagatgatcctccttctgacatatgatcagaagatcaatagtagcctaatgctacatcacaatgcctgcattatttacctcacttcatctcattaggtaagcattttatcatctcacatcatcataaaaagggtgaatgcagcgcaataaaatatgggccaggcatggtagctcacacttgtaatcccagtactttgggaggctgagattggtggatcacttgagcccaggagtactagaccagcctggccaacatggcagaaccctgtctctacagaaaatacaaaaattagccaggcatggaggaacatgcctgtaatgctagcgacctaggaggcaaaggtgggaggatcgcttgaacccagaaggcagaggtttcattgagcccagatcatgccactgccctccagcctgagtgacagagtgagactctgtctaaaaaaaaaaaaaaaaaaaaaaaaaaaatttagagaccatattccatattcccataattttaattacagtatattgttataactgttctactttactgttagctattgttcatctcttactgtccctaatttataaatcaaattgtatggtaagtatgtatgtatagagaaaaaagcatagtgtatacagagtttggtactatctgctgtttcatgtatccactataggtactggaagatatacccccagaaaagtagagactactctataaagaacatatataacccaatagcaaataaagcaaatagcccaataaaaatataggcaaaggagctcaatagacatttttccaaagaaagccatgcagatggccaacaggaatataaaaatgtgctcggtgttactaatcctcaggaaaatgcaaattaaaacaacaatgagatatctcatagcattcaataagacagttattatcaaaagtcaaaagatcacaagtgttgttgagggtatggagaaaagggaccccttgtacactgttggtgggaatttaaattgaaaacagtatggaagtttttcaaaaaattaaaaatgcaattaccatatgattcagcaaccccacttctgggtatatacccaaaggaaataaaacgactatctcaaacagatctatgcactctcatagtcatagcagcattattcatggtcgctaagatacagaaacaatctaactgtccatccacaaatgaatgaataaagaaaatgtagcatatatatatatatatatatatatatatatataatgaaatattatttagtcttacaaaagagggaaatctttacaacacaatggatgaaccaggacatcctgctaatttaaataagccaggcatagaaagacaaataaatattgcatgatctcacatgtgaaatataaaaatgaataattaaataaacttatcacctcacttcattcctatttttctgtatgtggtaaaaacatctcagatctatctattcttttagcaaatttcaagtatacaacaccttattattaatttatagtcatcatgccatacactggtatgcaaaacttatttaccttaaagcttgcatcttttgaccaccatctcacaccacacacagaaaaagtaggtatgaggtgaggtgatggatatgatagttttattgtggtaagaatttcacaatacataagtatatcaaagcattatattgtatatttcaaatatacacaattttgtcaattatacctcaataaagctggaaaaaagaaatctaatagctccacttaaatgatgttcagcttcaacgactttgtttgccaaaaaattttgttaaaaggtgttacagtaataatcatcttctttaaaatgagcactaaaactcagaaaattaatatagatgtacataaaataatgtcaatttcttaaatcctagagcatttggtttttaaaacaagagctgtgatttctattttgattggggctctgataaaagtcagccagattcatttgctgcataaattactcacagatcattaacagaagttttttctgcagctgcaataactcatccaggctgttacagaactatgtaactcactgcaggcagaacttcctaaatgtcaacttaggaaccaaagaggtttcatggatctatatgaagctttagtaccatcctgggttttgaacacagacactccacagacctgtgactgtatttacagtagcataatgattcagttgctatctaacatctaatctccagcctctaaatatgccacaaatgccactgttcactgcttatgtgctagacttgcccaccttgtctcatacctacttttaactactcttctttatgcttctccccataattttatgctaggcagtcacctccattggaaatatttagaaagagccaaaaatatatttaaatgtaagaaactcaaggaggaatgcacaatcaaggaggaattatgaggaaatgagtagggatgcaaataattcacagggtactaaatattcttccatcttccaatttccctttatggtacttttccatattcatcctcaacttgagcttccaagataataatgcaatagcaattcatatccctagattatccacagataaaatagactgtagcagctgctgtcctctgcccaggtcccccttcagtcttcaaggatgtagtccctcagctgcgtagagtgctatggctgacagtcctcaatgatcacctctctcttggaattgcctgttggtggagagagctgcctctcttgatgtcacaatcctttcctaagggaaatctgtttccaatgcctgttgaggaagcttggcccctcactcactcaggtgcagctttcaaagacagctatgagggggaattctctcagtgtgcagggcttcacgcactacacttggtcatcaaattcatgttgaaagagatgcagcctcagcctcagtttggaatatacacagacgggtaggtgctgaagggcacagacagatcatcagaggcctagtgggagagaaattaggagatcatagacaaggatatctggagtagtgttgtgtagatgacactatgggagaagacacaatgtgggaagatctttcagttgcaggttaacacctaccagaaatcatctattttggaagaggcactagacagccaagtagatggactgactcagccacttgatgccagccagtttctgtcattggccattccagtgctgctgaaatgaacacatgaaaagagtagctttagtgtcagagatgttaggttatgctcgggcccaacagcatgggctcccattcatcaaagctggtctagctccaggtgctgccgaacagcaaacttgccagtaacaaagatgacatcttcatccccaatattgcatcatttcttcaggagatcatcccatcactaagcggcaagttcaccacagtctacttctttcatcttgccagggtcagtggttcatttttgacagtaacaaattctgaacatgaatttgctttttctgtccccatggtttcaggcaacactgttatctgaatgcttgcagagtgtcagatccaacaacagcaatttcacttataattatgtcaggcagagggacaaaccttaaaaccaagcaggtccatcagtgggtccataatgacaggatctgctggtcatatcacaagccacaccactctattgcatcaacctgatagagtgctgaaacagcctgttgaaacacaacggaggtgtaggcccagacatgcttccctgtgagaatgagacagcactctccaggacatagcatctatcctgaatcaatgagcattcgcgggctctgggttcccgataaacagaatacatagatgagaaaccaaagtctagaagcaagagtggcctctgttaccaacattcccagtgacccactggagaatttgtgcttcttgttcctgcaactctggggtctgtgggtttaaagatcttggttcccaaaggaagaacatttctgccatgaacacatcatcatttcccttgaatctaagctgtggtagcttcctggacacattaaatttctcatggcaaaggacaaaaggacaagaaaagcagtcaccatcctaacagaggtaatggattctggccctcctttatgccccacctcaggaggaggagctgctgctacagggaggaatatgctggcaatctacctttggaaagtccttgaccaattgtttcggtaaatggacaagtgtagcggccccagcctgaggcaggtatagtgcccagggtttcatgccagtagatgacccatccagaagagcagaggtgatgtctgagggtgagtagaatctaggatggacagtagaagagggagactgtgtactaattgtgggtcttgagacaaaatgcagtggtcaggcctgtaattttccttcaggatgctcactggaatccctggagaggctaccccaacatttaagtaaagaagcagaacaagtacagcagggaatgagctatagtagacatagctgagctgcccagattctcccgcaggattgaagggcctgttcctcccctttctcctcctggcactggtagatatcagcccagagatgtgcagtgtactctgagcacctcgagtttggggcttgacttacagtgccatggtgcttaacacacttgaagagagggtgaacgactgtgtgatagaatgactgttttaattacagcgtagcagggtgttgactcttctcttttggctttgagacaatgttcttgttcaagtcatgaagtcacctgtctttagaatcactaagacttggtccaagataacttagttgactcaaacactacattaatcatgttatgtgacctatgaaatagtctgctggaaagcaaattatgtcatttcattaaatcatcttatcagggatgaccacaaaacccatgaaataagccactttttcttaatttctttcatagatttcatattattcataaacaaatttttaagaaagtaatttaatttgggtacaaaaataattatatattaagatacactggattttatgttatgattggaaagtcatattcatctggacgcatttaggtagcagctgtaggatcttatgtaagtttctgaacttttctgtattttaatttctgggccttgtttgttaaatataccttccttttaaggttgatgtgaaaattatatgagtcagtaaggcacttaaaatgtgcttgacacagagtaagccgtcatgttattattatttttgaatgcctatcgtatgtcagagacaataagaaggtttctcttggataattgcttgtacacacatcatctcatttaatccacacaataaccctaatgtatagctgttcttcatgttacttatgaggaaaatgagggccagaaaaatgaagcaatcggctcaaggtcacacagctagatagtggccatgctaaggcagcaaaggtcaaagctagaagaaacaatcctgtaggtaccttagcaattcttcacagtctttcttttcttggctttattatgactctttccatctggccatgtcatctgtttggcctattctccagaagtcaagagattagatctgaatctcagcagtcttgtccttgatgcaatagagagctgaaatcctctctcagaatacatatcaatataggccgggcacggcggctcaagcctgtaatcccagcacgttgggaggccgaggtgggaggatcacaaggtcaggagatcaagaccatcctggctaacacagtgaaaccctgtctctactaaaaatacaaagaattagctgggcgtggtggtgggcgcctgtagtcccagctacttgggaggctgaggcaggagaatggcttgaacccaggaggtggagcttgcagtgagctgagatcgcgccactgcactccagcctgggcgacagagcgaggctccatctcaaaaaaaaagaaaaaagagaaagaatacataacaatataaagcttgattcttccagcaactctgggaaccaactctaagtttgctgatgaaatacctgttccagcttacctctcaaatattgctctctgaatattttttgttgaattcaaagaagtttgcatgcttttatccattcgagaacaaaattttctgcaaatacacctgagacatacaatatatgcatgtggatttttttactgaaagcaagtttactgctctatccttccgtttttcttcaaagtatcaagttgtactgaagtttgttacctcagtgctgaatgccattttcttttttttttttttttttgagatggagcctcactctgtcgcccaggctggagtgcagtggcacgacctcagctcactgcaacctccacctcttgggttcaagcgagtctcctgcctcaccctcccgagtagctgggactacaggcgctcactgtcatagccggctaatttttgtatttttagtagagacagggtttcatcatattggccaggctggtcttgaactcccgacatgaactgatccacctacctcagcctcccaaagtgctgggattacaggcgtaagcccctgtgcctggcccatttttatatcataaaataaagctacatatttatttacctatacttttcaaagtattgtcacatagttattctatctaaagcaagacttaactttcaatgttcaattaaatcattcactgcattgtgtttatttaacattatatcaccattggttcacattgtatgtcctcctttgaactgagtcaaatattaacagtaaaaagttatctttttgataaaagttttaagcacactaaataggaaatttataatgaatctcagttatagatctgttaaaatatgtttttaaaggtatatttcaagttttctatcagagaatatagcaatctgatgagagatatctagtgcctctttattaatagaaaatgactgaagcttagtctcactcttgataaaatcataaataattttttgaaaaccacatacagataataatgaatgtctacatttataagaagtagaataatgttttgttatatcatcatctattagaaacataaaattttttaaactacaataactgtaggtccatggactgagttgaattatttcattagaaaataattttaaaagaaagccgattcacttatcaacataaagtattgtgaaatggagttaatatcttacttgtaatatttctagactttttaaaagggctaatattaaaagagaaagagagagagagagagagagagaagcttgattagccatcagggaaatgcaaatacaaaccaaaattagataccacttcacaccgagcgtgaagtgaatggctacagtagaaaagacagacaatcacaagtactggtgaggatgtggtgagatcggacccctcatgttctgctggtgtgtatataaaatgtgcaacttctttggaaaacagtctggcagttccccacacagttaaacagagttaccacatgatcaagcaatttcactcctaggtgaatacccaagaaaaatgaaaccatgtgtccacataaaagtctgtacacaaatgtatacagcagcattattcatatagccccaaagtggaatcaacccaagtgtccgtctgatgaagggacaaacaaatgccctcattcatactattaaatggaatactattcagcaataaaaaggaattcagtacagatacttgttacaacgtgaatgaatcttgaaatcatgttaagtgaaagaagatagtcaccaaggatggctgtatgattccacttataacaaatgtacagaataggcaatttataaagacagaagctagataggtgattacccaaggctggtgaaatggggagatttaggagccctgactgagtgcagaatttattttagagatcataaagagtgttttaaaattgactgtgatgatggctgtacaactctgtaaatatgctaaaaataattaaattgtattttataagtgggtaaattttgtggtgtgaagattatatcttaacaaagttgttaaaaaaagagaaacagtgaagtgtgtcatacttaaatgaaaaaaatcttcatttccctccaaatttattttaaaatcttgccaaagtgtagtatatgtaataaattgaacgatgaatagtactggattttaatcacactttactaattcttaatcaaaatatatgctagatgaatactgttcaatttgtaattactttgcataggcttttaaatagtactaaattactctaggtatgaaaagtctttgaaatgaatattccacctatagaaatatatcctttggaaataattaaccacatgtataattatttcacttcaagaatgttcactaataatgtttctgataataaaaatttaagataatcaaaatgcccaacattaagtattagtttagataatttcacattatttaaagattcaatattctccccttttaaaaaagctgtgaacgtacctattgaaatgaaaatgcttataatatggagtttaatgactaaaacagttttaaatgagcatgtaccgtgtgatcatttttcttaaagatatgcatggaaagttatctattaatagtaatggttgtctctgggcagtgtgagcatatgattatggtgtgtctccttttattcatctatacttacaagtctttcctataatgagcatctattgatttggtaacatgtaagatatttttaattttaaaaaataaccaaatcgcattttaatgttaacagcaagcagcacaaagtactatgttgctccctgaatatttcaccagaagggttaacttacattaccctggaaggaagacaataagaaatggtgagcctgatggaatagagagagaggctgaggagtagttctacctgcctgtttttccatggtgacagtggaatattaatcacagatggatgagacttaacattgctcagactatcattagctgttttcatcaatcactgtccagttattgctaatcctctaccattctcatcctgtggggggtggaaaatgacagactgcgtgtatcaagcaaggttcccaggtacaagcaacaagaaaaaaaaaatgaagttggctatgttaagataaatgaatcaactggaagtatgtagagggctcagaaaacaaaggtgatgtaggggaacctgcttaaacaaccagtaagaacaaaagaagttctagaagccaagttgcaacaaattcctagatggaatgccaatacccaggaccactcttaggcccaggcaagaagggccattgccccagctctgggttttaaagaaactctggccctgtggccttgtccctaaggcaagagtctatgaagttgaggatgcatgttacccagatcccaagccctgccttgagaccatgttgggacacgtatgaccccaggattgtttgcacaagtagtccttaactcactcaaagcctatgcagtcctcttcacaggctccacccactcgaacagaaactgcatacaggtggacctaggagtagccaacatgcagctttctgttgggggttatggatgaagcttagatctataggtcaggctgtccacttgtgtaggcacaaatttcttacagagcaaaacacagccaagagcaagaatctaggggaaaagggctcgcatactaagaccaaacactggaggccagtattcccaagcttccagaatccagcatgcaagccccagggagctaagaattctaaactcaaacatggccacctgggtttttatgaaggcacatttttccagggagtagaatagatatacatattatgtatatgattaagcagtttttaagattaacctacaacttttaaatatttagttttatggcatgtggacttccatgtatacagttgggtcttgcaaatgtcatcattgccagacaaacctagcaaagtctaagtatatgctggtcactcctttatctttgcatttcttttccctcaagatacaaagacccagaaaacaaatatattcatcccaggtcataagtcacacccttgctgccaggtcttgagagagggggatatggcctttggcagcctctccagtgggaggcagggccctattgacccacaggaacacacataatggcgatgacctgctcttcttctattaataaggagagagaagtgcatgctggacagccaaacaaggcaaaacccaaagaaatatgcattgtattgggaggaagaaggccatccttactcaactagctatatgaggtcaatgacattaagcctctttttctcccttataaaataaccataaaaatccctacttcattggattgttaacaccattaaaaagataatatgtgtgaaaaaatgctctgcaaactgcaaagtgctatacaaattagcatattagtgttatactcttgggagagctctggcagttgctaatcaagaattaagagaaatatgctaattagaggagacacctgacaatgatgaagataggtggcaggtaagaccccacctgcttcaatgcagccctattcaaatctttacattttgtatgctgctactcagccccacattacaataaatatctcccacataatctgcacaatttccctacaataaattgtcaagcttcatctggtcatccctataaactcaatatactctaagcaggttgttaagtacattcaaggatttcacaatgaacagctgagatccagttatcattaaaatgaagtgctgacactggaataaagccacaagaaagtgtttactgctactgctgctctggaattataatcatttctttgcttggcctttagaggactgaatcatctgatgcatatctatcttgtttagtaataagatttgaaacctaatgttgaaatgtccatatctatgtttattagaactagaaaccaggtccacattaagctcacaaaaccatagcttctttattaattgcctacatttattatctatgctggctgcacacaattttatgaagtgataactattttccagtttaacagagtatgagctgcaaagtggagagtttgggaagaagcttgacatttagtaggaagcaaaagataagagtgaagtgttcctctcccctctccccacggtctccctctccctctctttccacggtctccctctgatgccgagccgaagctggactgtactgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatctgccagcctcggcctcccgaggtgccgggattgcagacggagtctcgttcactcagtgctcaatggtgcccaggctggagtgcagtggcgtgatctcggctcgacacaacctccacctcccagccacctgccttggcctcccaaagtgccgagagtgcagcctctgcccggccgccaccccgtctgggaagtgaggagcgtctctgcctggccgcccatcgtccgagatgtggggagcgcctctgcctggctgcccagtctgggaagtgaagagcgcctcttccaggctgccatcccgtctaggaagtgaggagtgtctctgcccggccacccatcgtctgagatgtggggagcacctctgccccgccgccctgtctgagaagtgaggagcgtctccgcccggcagccgccccgtctgggaagtgaggagctcctccgcccggcagccgccccatctgggaagtgaggagcgtctccgcccggcagccaccccgtccgggagggaggtgggggtcagcccccgcccggccagccgccccgtccgggaggtggggggcgcctctgcccagccgccccttctgggaagtgaggagcccctctgcccggccaccaccccgtctgggaggtgtacccaacagctcattgagaacaggccatgatgacaatggcggttttgtggaatagaaaagggggaaaggtggggaaaagattgagaaatcggatggttgctgtgtctgtgtagaaagaagtagacatgggagacttttctttttgttctgtactaagaaaaattcttctgccttgggatcctgttgatctatgaccttacccccaaccccttgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttacctgctgaccttccctccactattgtcctatgaccctgccaaatccccctctgcgagaaacacccaagaatgatcaattaaaaaaaaaaaaaagaatttgacaaagtaaaaaaaaaaaaaaaaaaaaaaaaaaggagatttactaatgtggaagattaatatggaagattcctgctatatgttctttttttttttttgagacagggtatctctatgtcacccaggttggagtgcctgggtgcaatcatagctcactggctcactgcagcctctacctcctgggctcaagtgatccccactgcctcagcctctcaagtatctgggaccataggcatgtgccaccatgccaggctaatttttaaatttttttgtaaagatagaatcttgccatgttgcccaggctggtcctgaacttttgggctcaagcaatcctcccacctcggcctccaaaagtgctagaattacaggcatgagccatcatgcctggccatgttctctattaaataaaagccttccatctctttcttcatttcagccagttaaattgagatctaaaggcttgaatttactatttaatgctacctaatgacatttcagagactggctataaaaaagcaagtgttgaaaattaacaaaaacgtctctacaaaggaaatgaaaatgttccctcttccttgaaccaacagagagagaaatatcctttcactttataaaatgaattccaagactctgatttgatgcagcgttaaattgaaaacatttaggaaaatatcaatcttgttttctccatttccatttgtgcaaaatggagacttgctgactattcataattatcaacttactctgtactgttttctattaatgtgaattcattggaagtatactttgaaaaggaggtcatgtaaaactcttgtcctgggaaaattactttcaaaattaaaaaaaaaaaaaaaagagtgaagtgttttgatttaggagaagatgtacatccaaagagacttctgtcttaggaaacatgagaattttgctgtaaagctcaacctagatgcaaaggagactaaagacaagcatcccagacaattatagaccaagcattgggaaaggaataagttgggactgactcataagacacttagatgaagctaggacaatggacattacgttagctaaccctgaatttgtgctggaaagatttgacaaaacctaaaccttatctatttcttataagtgcagagaacaaatagttcaaaacacagtatctatagataactctgtaaaacaaaacaaatttgttgtttggttaattctcctcaagacataggttgcaactgatattaaatttcttctcatagactatcgatttacagcaatggattggtcaaggaaggataaagaaacttggaaagaactatcatgatacctgccctgagaagccaaaatttggtttaactttgtgttgtttactgtttggttctataaaagctaagtttataaaatattgtatgacaggtgaatttaaatgttactaaccatcttggatgtcctgctcttctgctgtacagcaataaagtctctctaaatgcaatgtttgggacagagttgctctgggaaatatagtggtttgaaaggtggctattgtacccaagatgaatatgttattatctcattggacatagcatcaaatgttatttatgaaaatgcttatcactgccacaggcttctggtctatacccatgaagacatcgctcaagcatagcacctcaacagagtgaaaagtgcaacccaatgctatagtaaaggcatcacctaaaacttccttgcctcagacacctgaatggcagtgtcttcactcaggtccccactcaaatgtcaccccatcagcaatgtcttcaccaatagcactgtataaaatggcaagtccactctccaaacaagtacttcttctcctttctccacattatttatctccaccccactatggccatctaatgaagtctgcatgtatttgattctacattagttttccctctctccctatatttttgcatgtccagctccatggacccaaaagtacagtctgagcaagatgtttgaaaccacctttgcaaaaattatgacattgaaagtaatcggacatagctgaatccatcttgcttctaacctcacatgctgcccttgttcacttctaggcataggccaagctaactatgggaggaatttggtttatagtttaactttaaacaaagacaaccgtcctttcctgaaactaactcccttcccaatggctcctatagatactactattgtaaaacctaacattggtgtttgagctatttttttgaccctacattctgatggatcagctggcaccacctggcctgataacccataccaagaaactggtttatctggtcttgtgaccctcacccaggaactgactcagcataagaagacagcttccaactccaatgatttcatccctgacccaaccaatcagcatccccattccctacgcctctgcccaccaaactacccttgaaaaaacctagcctctgaattcttgggagggcagatttgagaattatctcccatccttctgcttcgttggccctgtgattatcaaactctttctttgctgcaaaacctgctgttctcagtgaattggcttttctgggcagtgggcaagaagaagtagtcaggctgttacaccttcacagcactcagtgatggttcttagatgaaagtaacaacttataagcacgtggatctggatgagtccagcatgtcccgagatgtgtagcatgtttgcgcagtagaacaaaggcttcagggatgtctggttcacatgtggcagtcaaaaaagtcacaatattaaattataaaccttcttccttccccttcctttttttcctttagattctcaataagattctattttgaaataaaatagaacaaaggctgatgtgctactaacaaaaccttttgaaggaaatttcaaaacaagagcaagttaaggcatgccaatttattatcatactcttggattaaattcccactttttgcctgtattttcacatctgtaatttggaggagtaacttcatgggttgttaaaacagcaattaataactgtgtgttttaagtgttagttttaaatattactttctatgtagcaaaaagatttctgatagtgctataattctccaaagagtagggtcctgagtaaaacagaatgtcactgttactacttgacgattgtcttctgaaataacatattcaaacccatgtactttacttactatgaagcattttatggctttgacgaaaccatttcaaccccattctttcccatgttttaagggtttttttaggtagctcaaactcagcacatccacgaaatatctcatcatctttccccccacactctgtgtctatacctgaattctctttgatgaatagcaaaatttccttcaagttactcttaccaataactttggaaatatagatttgtgaaaggaaaagaaaatctcaggaccccaaactctctgtcaaagggaaagcaagtcacacaaaaaaactgccttcctcttgttcccaagcagacaactgtaatttcacatgtgaaatgtagatttgccaagccaggaaaagacatacttgaccttttccaccactcctctcttttcacatgtcaaacaaagatttttgtgagtgctaatcaaagcctcgcaagaatgtaatgaccacactgcctaagttctacctcccccccacttttttttctttcctccttcccctcctgcctgctctttccccctgtagtattgaagttctcaaaaccttctttggaaaaagcacagtccacattccaggcacatcctcaactgtggcaatatacacctctaaatctgtggcagacacttttggtttacagcatgatgcatcctgatggatgcattctgaagtcagattgagctgcatctaaactctgctttaccaacacctgtgcaatctcagccaagagctcgaaactctcagagcctccagttccttcgtcattgaagtgagtacagagtacccactcataggttccttgtgaagagtaaatgagataatgttcacaaaatacttagcatgctactggcttataatatccattcaattaaaattgatgatgatgattcaggctttaatcatttcttgcactgatggctttcttgtcagtttttctttcaggaacatgcaattcttcctactctggttttgtttctccgcatgtctacagagctgccagagggttacatttaaagtacatgactgttcatgccaatctcctactgtccttcaatggctccccaaggctttctttctaaagtaaaaactcctttcattagcacgcaagtcccttcacggattgagtaccctctgttcctctaacctcatctctaacgctctcaagacttgccatttctgcaacagacagatccaactgctttgagcacttccaatgagtcatgcagatcatgtgtctgtacatcccacccagatatacgaggcactagccactgttccaatttatcaagcaaatgcttactcacactttagggaaacttctttaataatttagaatcacctgtatcttttctcccccagcatatacatactcccccagtgtatgtatatttgttgcaaagcttattacattttggtgtggatgtgatttacttgtttatttctttccaagtaatcaaaccaattcatctttccatctcacaatgttagacaccgtgcttggcacatacagatatataatggatatatattaactaagcagatacatatgttaaaatgagatctgagtcatgaagataatgagcttctctttcccagctcactgcagtactcttcttactgtgcctgactctgatgggctccattttagaattttaaggttgtgaggttgtgttaccagaaaggggtcatgatccagaccccacaagagggtccttggatctctcccacgaaagaatcagggtgagtccccagtgcaaagtaaaagcaagtttattaagaaagtagtgaaagtacagctactccatagactgagtagggcgtttccaaaagtaagaggaggaacatgtccaccctaggtacaatgcttgtatacacggggagatgtgctctgccacaagggtttgtgataaaggattaattttcttaattactgtattttgcaagaatcaatattattatctttaaagcaaaattaggagtgcctttgttctccagatatcgggatatctggacacccccaggtcaggtttgtttaatcaacattattaatctgttcccttaactgtaaacatctagaggcgagaaatgtgtgactttctgggaatgcggcccggcaagtcccagcatcattttcctgcccctcactcaagatggagtcattctggtttcaacacctctgacagttgacagggcattataggtaaagtagtagatctctcatcagaaacaagaatccccactacaaccaggccccaactcaccttatttcagaaatgagtgaaaaagaaaacatcttcaaagaggttatctgtgctcctgtcccttacgagcaagataaaatccactgtacttcacttagtactataatgttaagtgtctgcttcaaggtgaaagatttaactgctattttttacacgtggcactgataaaactcaaaatgggacacaaggcagaatagcatgacaatgacatcagatttagggaggcccaagtacgtctgtctttacaggattatttcttagaagttaactgggctcagagagagtatattcaaggtcttttttttccttttctttttaattagtgtgggtcagaggaattttgggagtggatcaatagattgccaacctcccactacatcaatgtaccttccaagggaaaatagacaatttagttaagctctgcatttcctgaacaacttctggatcaagagttcattatctgctatatttgccaatatgtaaagccttcaggatagttgccataattaaacaaacaaaaccttgtatttgcagacatatgatttgagattcaaaaggatttcttcttttatttttggtgttagctttgacccttattctgcttgtcactttttctttagggagtgtgcaattctaaatgcttctcgcttagacagtagctttgacatccagtacaagtggacccctcaccttttacaaaacagttaagctacttatcagatttcctggtttctcaaaccactcttttctatcaggtggaaaggactattctcttgggagatcgagggccatgagatataattaactttccccatcccttccctcttaggaaatggcttttaaacaacttctatgcatcccaccatggtttatgactacactatattaaacatgatgaagcattttcagagaggagggccatcattatgaagtgagtttaaaaacaaattcccatgagatctgataattatctcatggagcagagattatctgcctactgtaagaggctttattttgttcactgctgtgctcataataatagcttgcagtgtgatataaaaaggagagagtgaagcatacaatctcaggagaccagagacaccacttcagttctataaaggaaatcagacataagaagacaaaaacagtgcaaataacaatcatattctgaaaaagaatttgatcaactctcagtcatctttcttggttcacattgacgcagtttagcagaaacatttattgttcgtattattccatgtctctggctttcattcccacatgcagtctacaaatcaggtggagatatttaaaccaaagtacttcattcccttccccaaatgaggaagtagtgatgagaaaaaccgcagagaaagagagagcaagagcgcgagagaaggagagtaaagataagaaggctagcttactctgacacttgtcaccagcaggagatgtggtctagccattcctcacagagcaggaaaccaggggctgttgcattcagctgtgagcagaagacagagagggagcctgaaggtgggacttcattatattatttaaagcaaatttacaaaatctcctattcatgcgtaagttaaagtacagaatcacatttccaggccaagtataaatgcaatattgtacttagtaccaattcaaataaagacgaatggataattgagacctgtgagcaacacactccttggtaccaattcaaataaagacaaatggataattgaaacccgtgagcaacacactcacaggtgtcaggattggagtaccacagaaactgatcatcgctgcagccctacgagagcatttggttccatcctctcactctgcagatgaatataagccagagagatgaatcaccacactgagacccagactgggtggtctttctccaacgagttatgcaaagattatgtttatgttacatacaagtaagttgtgtgtgtgtgtgtgtgtgtgtgtgtgtgtgtctttttggccattttaagagtatagtatttccagggggctgttgtaagtattatgtgtctcaaaacatcaaaagagtgtagaatcctagtggatggaaataatataataatatttattgcacgcctgctaggtatgcaatgaggtatgttacctatattgtcacattaattctcaaacagccctatgagaaacacctcatcttccaggtgaggggtgctgacactctgagcagttaagtgcctcttgctatgttgacaaagaaatggagaatgagtttaaacctggtcactggtgtcccaaatcccagtctttctgcctcattagactgccttcggcacgtccactagcatggtctcaggaaattctgtttgtgaagttcctgcttgtgttttagcaagcgaacgagtcgttggaaataaataactgtcccgtgactcccactcatgacttttcttgacaacctgatggcagcattgcacaagatggaaaatgctgtgcgatgtctaaggagggtggagcaggctcagctgcaacatgaaacatccatcttcctttagcgtctcctctgcacatcattcacacttacagtgcagcccaacttttctcaagaaaagccatcatgtcccgtgaggctttctgggctctgatcctaaaaggacagtacatttggaagctgcctttgaagcctgttcacacatgtctgctgctgaagttaagtttccagtatgtgaggactctcagcataggggttggataaagtagttgatgaggattcacgtgtaaataatgaaagaagcaagtcgatctttgttgctgttattctgagggagaaaatagatgggctggcctgccactcagaggctgcaaggaataatttatcaggtgatgttatgtttgaaacacaaaaataagagttaggaaatttgaaagttggtcagcattaattttctgctagcaaacaactagagatgttgtcaaaaatgccagctaaggcatttaatgagggggtgtaccatgaaaacaagtagcagacacaagctcattcattatctttgttccttacctgtgaatactgaacaatttgtctttctaaatcagttatgtttatattatgatcattcaacacagaaagaattatccaatctaaaatcacctaatttatctagatcagggtttggcaaatattttctgtaaaaacccagatagtatttctggccaaattagacaaatcctggcctatttttttttttttttttcgtaattgttggcagtagcatgtttaatatgagaaagtcttctttgtttatgttcaaggacaaggagaaagagaatttgggagagatgatttgagtaggccagactggaagcggcagtaggagattacagtacggctgcttccttgctgtgggggatttatctttgtactctttgcttgggagagatagttaatgagtcttaacatcggctcacgacacaggtgatttgccagaaaagagtcctcaagggcgaattaaggaacagcccagaacaacaggatcccaagttattctatcatggtaacttctgtctgttcaagaccacacagcctcatctctcaatagcacttttttccccaaaagaaatgctattttcaacatctgacttaatttcacactgagttcctttgtttttaatttttaatttaattattataggatgtgattattttgtattcaacggggcttactttgctttggatattattatactttatcttagcctttcatcaaataacagtatcctacggtgtaatcaggcatcaagagatagagaaagatcatgcatggttttagggtccaggcacttccacatgcaaagcatctaactatagtttctctctgaaccccaggtggctcatgtatgaaatgaggctgggtgcggtggctcatgcctgtaatcccagcactttgggaggctgaggtgggtggatcacctgaattcaggagttggagatcagccagccaacatggtgaaaccctatctttactaaaaatacaaaaaattggctgggcatggtggcaggtgcttgtaaatccagccactagggaagctgaggcaggagaatcacctgaacccgggaagtggaggttgcagtgagccaagatagtgccattgcactccagcctaggtgacaagagtaagactgtatcaaaaaaaaaaaagagagagagaaagaaagaaggaaagaaagagagagagggaaggaaggaaggaagaggaaggaaggaaggaaaggaaaggaaaggaaaggaataatttctcactcctaaggtcattgtgagaactggagatgacacaggcccagtgcttgtcataatgtctagcccatcctagatactcagtgctggctgttcgtagcctaatatagcaaagtgctgctttcaaagccatgtcactttgtttctctcgtttttttaagcagctgaatataatgtctattacgtgtgggagtctcctttttctctgaagtaaattatgtctaaacaatttatattatgaatcattgggatgggtgtttcactgtctagaactcatattttcctatgacttcccttttgactcattatacttagtgaactaagtttctagtaacagtccaggaggcaggggcctgtttcatgactgacagtggttttgtgctgcgaagagatcaaaaggcttgattttacattgtcataccttatttttcctggactttgcttatgctctgttgatggtgatagcacaaggattcctataagtttgtatataataatgtagttgtttgtagaatttggagcttagaataagtattttttttctttaaaacagaaaattgtaatagtttcccttaaagggctgtcctctcacacagttaaaattagctgtcttactaggtaaaactatattattttgtaatgattaaactagtatggccattcacctcatgtctctcaacagtttcttgtcaaatttgggagaaaaaaaaaagcgaccttataagattactgcattccaaatgctagagtgcattatgcctgggaccaaatgggacaggatatatgctcgcctctacttggctgtgtaaaatttgcttggaaaagagacattctgtcttttgaaagagagcatgactttcccttgcattgtgatctatgagctgtagctaagagcaccctcggcagtgcagaccctaaggcaaacctaccacatgtgtctctccttctcccaaggatgttttctacaggcaaaacccgaatagtagagtgagcataaaggctgtcttgagagagagagaggatccagaaatttttaaagaattgcttaattgacttgtttcatgctctttctattccccctccccctcccacacagaatagatagtgcatcatctccttttatctcttatcttgtttctgtggggtttttttttttaacgtcattcatgctgtaaatcacttttttgtttgtttgtactttgcttctttatttttaatttttccataagttattggagcacaggtggtatttggttatatgagcaagttctttagtggtgattggtgagacactggtgcactcatcacccaagcagtatgcactgcaccatatttgtaggcttttatccctcgccccctcccactctgccccccaagtccccaaagtccattgcatcattcttatgactttgtattctcagagcttagctcccacatatcagtgagaaccatacaatggtttggttttccatttctgaattacttcacttagaataatagtctctaatctcatccaggtcactgcaaatgctgttaattcatttctttttatggctgcatagtattccatcgtatacatataccacagtttctttatccacttgttgattgatgggcatttgggttggttccatgattttgcaattatgaattatgctgctgtaagcatgagtgtgcaagtatctttttcaaatagtgacttcttttcctctgagtagatatccagtagtgggattgttggatccaatggtagttctacttttagttctttaaggaatctccacactgttttccacagtggctgtactagtttacattcccatcagcagtgtagaagtgttccctgatcactgcatccacaccaacatctaccgttttttttgttttttgattatggccattcttgcaggagtaaggtggtatggcatggtggttttgatttgcatttccctgatcattagtgttgttgagcattttttcatgtttgctggtcatttgtatgtcttcttttgagaattgtctattcatttccttagcccactttttgatgagattgtttgtttttttttcttactgatttgcttgagtttgttgtagattctgggtattagtcctttgtcagatgtatagattgtgaagattttctcccactctgtgggttgtctgtttactctgctgacagttccttttgccttgtgaaagcgctttagtttaattaagtctcagctatttatctttgtttatattgcatttgcttttgggttcttggtcatgaaatccttgcctaagccaacgtctagaaggatttttccgatgtttgcttctagaattgttatagtttcaggtcttaggtttaagtccttaatccattttgagttgatttttgcataaggggggagatgaggatccagtttcattctcctacatgtggctagccaattatcccagcatcatttgttgaaaagggtgtcctttccccactttatgtttttgtttgctttgtcaaagatcagttgactgtaagtatttgggattatttctgggttctctattctgttccattggtctatgtgccggttccctccctgattagcttaataactaacctcctgaattctttttcaggtaaatcagggatttcttcttggtttggatccagtgctggtgaatcagtgtgattttgggggggtgttgaagagcctcattttgtcatattaccagggttggttttctggttccttctcatttgagtaggctctctgagagaaggtctagggctgaaggctgtcgttcacattctttcgtcccccaggttgttcccttgatgtagtactctcttccttttcctatggatgtggcttcctgagagccaaactgcagtgatcgttgtctctcttctgggtctagccacccagtgggtctacccggctccgggctggtactggggtttgtctgcaacgtcctgtgatgtgacctatgggtctctcagccatggataccagcgcctgttctggtggaggtggcaatgatgggggtgcaatggactccgtgagggttcttagctttggtggtttaatgctctatttttgtgctgtttggcctcctgccgggagggggcgctttccagagagcatcagctgtggtagtgtggcgaggaaccggcggtgggcggggccctagaactccaagatgatatgccctttgtcttctgctaccagggtgggtagggaaggaccctcaggtgagggtggggtaggcacctctgagctcaggctctccttgggcggtccttgctgcggctgctgtgggggctgggggtgagattcccaggtcactggagttatgtacctaggaggattatgtctgcctctgctgagtcatgcaggttgtcagggaagtgggggaaagccggcagtcacagggctcacccagctcccacccaaaccaaagggccggtctcactcccaccgtgcaccccccaacagcccccagtccgtttccaggcggagagggatacaggcctgaaaacctgccccaggctacccgcctcccagctgcgagagaaaaaggcttggttcttcccccgcctgtggagtcagcaccccggattcgtgccctgccctagttctggccaggaggattctcacccagttcaaactgttacaacgctcagctagagatttccttctccctgtggagttttaccccctcctctcccgatggatccctgtggtgccagcaggaatgggctgctcggggacccagcgagctccgcgggcctttccgctgcttcctctacccctgtacctcactgggctccccagacggactcagctccaggtaaagttggaaattctcccgcaagcagaccttcagcttccccagtgggggtgtgtgtttgggagaggagggtctccctctcccacttctgcagttggggcactcacacttttgcgggggtctcccgggtcctgcaggagcagcccacttccttcagagggtctgcgggtcctctcgggactgctggtttcttcctgcagtccatctggagctaaaagtcacaatgcgagccccgcacgctgccctgtcgggagctgcaatgtagtcctgcctcccgtccgccatgatgatctgttctcctgctgtaaattcattccagatccagattctttctcagcggcccttggtgtgtgtcagaagccataatcggtgtgtgctacccacccctactatgcagggcagcttcatttccatgggttgcattgataattattggcttattattatatttttctatgtcactttacatttcttagtgtttcttacatgcttagcatatttctacacatttttttctaattcccaaatgagaagaaagcaaataccaacagtattttctttctttgatcgtatatccctctgttcctgtgtcaggaaaatgtgaagattcaaaagataattgaaagatgattttaaaaagtatttaacatttattttaaaagcactaaagtttgttagcaaaaggcttctgttaaatgttgggagaaaagaaagacttttggaatttcatggaaatattattcatgtgtatttaccaattggttatatgagacatgaagttttttcctaagagataaattctgatcttatacaaacctgagaatctatagggtaagaggtggagaggagagacgaacatcacatacacatctagcaataatataataatataaattagtaaaacattcttgagtacagttagcaatctgtattgaaagccttaaaatacaaatgtaaaggtgggcgatagacaccttctctttagtaatcagaaaaattaaggcaaagttgccatcagttgagatacccagtaattttttacttgcatgttcctcctggctttgtatataattattgcaaatatagcttatagcctaattcctttcctttatgttttaaaactcctagtgtttctttcatgctgcagtgccttccttcagttcaactaatgttcacagaaaatctgtagaatgagcaggtaaatcctggaacctcagaatgtcaggaagtagagcagagaaggaggggtacgggcaggtgcgcagctcggcctctctcagtgctcgggtgtgtggtacaggtgagtgaacacctgggcttgcttgtgcccatagacacattaaataccagacaattaaagtaggacaaaatcaacactttcctggaacaccgggggcaagatcaatcccaggcaaacagctgccttcgtggctgcccttttgatattctactttctcaaattattcttacattctttcatttattcatcaaatatgttttgctccctacaacatgccatgtactttgctaagattagggtatatagataaataagccatgactgcttctagcacaagaatatgtataaagaaagttgtagatctatatagaagaatagaagcaaaggggcagagtggcacagtgaccaagtgcggacttgcaggtgagttagagtttcagaactcctttgtgtcatttatgtgacttgggtaacttatttaacttccatgagcttcagtttcattatcgtaaaaggggataaaatgcctatgttaggaagttatagtggaaatgaagtcaaaggaaagagtgtggtaaaacagcgagcatgtatttgggacacgatagcagccaaaatattgcttaagcattacacatatgtaacgtatctcctgcttacctagttggttttctttttttttttttttgagacggagtcttgctctgtcaccaggctggagtgcggtggtgcgatcttggctcactgcaagctccgcctcccgggttcaagcgacttttctgcctcagcctccgagtagctgtgactacaggcgcgcgccaccacgcctggctaatttttgtatttttagtagagatgggatttcaccatgttggccaggatcatctcaatctcttgaccttgtcatccacccacctcggcctcccaaagtgctgggactacagacatgagccaccgtgccccgccgctgctcaccctgtttgacgaaaagtttcaagtggctcaggtcctgggtggtcggcggggacagatggggagaggtctaccctcattcctgggccactacacaagctgtaaatgttctgtaagctctgccgcctcacctttggacgagtcattctttctccgcagtgtgcagacacacctgcaggttttggggagcagaaaaatctcattccacaagtcttaacacaaatccttttccctgtcacttaggccagcttctcagagtctctgtcttagctttgcagcggctgccatgctcaggaatgtgatctctagagtatcaggtgtgaacagatgtgggaaatataccaagaacacataaatcaaagttgcatgatacaaccacagaggtgatagaacagaggagtccccaaatccacccccatgaggtcaagaaaaatttctcagagaaagcatcctttgaaatgggctattgtaagaaaataaggaattgcatgggtgggacagatatgggagggtattccaggcagatgaaataaattatgaagtactgaatcccaaattatatatttgtgtataccccgtttgttccctgctagtgagtgcaaataagggcattttaatgccccatcaccatggctcttactagccaaactgaagggcattagccagccctgtcttcaaacatgctccatccactgttctctatcccagaacctgtaggaaaatatcagagatgttgagagagaagcccactcatgttctggtgctccactttccccatggaaagctgctcactggtaagtggcgtgacccatgaaggtcagtgtcaatgccagggggagacagtatatcctgctggatggagatgccggggggagacagtatctcctgctggatggagggcgtgcagttcctccatcacagcttgacactcccaaaaaatagcgacaactttgttcaagtgcaaaaagaacaatcggatttgtattggagaaactttactctggctgctggatggggaccggatttagggagaaccatcaggagcctgtcctcattattcaggtacaaaatgatcatggcatgagttggcagtggcagttgtgatgaaaggaagtggataaacttaagagatatttagaaggagaatcaatagcacttcgtgatcacctggagaccccgagcaacaacagggcaaagtcatgagtaatttagcagattctggattggaaatgggatgcagagtgctgctgggccctccgtgaggctgggagagctgagtgtgtgtgtgtgtgtgtgtgtgtgtgtgtgtgtgtgtgtgtgtgtgtagagctgggtaagtatttgggacagggaagctgggacaataacaaggttgaaactcaacttagagttggaggtgcctgtgggatattcaagcagagggtttccaccaaatgtcacaagcttgtcctatttcttttcttttttttttttatacttgaagttttagggtacatgtgctgaacgtgcaggtttgttacatatgtgtacatgtgccacgttggtgtgctgcaaccattaacttgtcatttagcattaggtatatctcctaatcctatccctcccccctgcccccaccccacgacagtccctggtgtgtgatgttccccttcctgtgtccatgtgttctcattgttcaattcccacctgtgagtgagaacatgcggtgtttggatttttgtccttgtgatagtttgctgagaatgacggtttccagcttcatctatgtccctacaaaggacatgaactcatcattttttatggctgcatagtattccatggtgtatatgtgccaccttttcttaatccagtctatcattgtggacatttgggttggttccaagtctttgctattgtgaatagtgccgcagtaaacatacgtgtgcatgtgtctttatagcagcatgatttataatcctttgggtatataccctatttcttctttgtgcatttccatgggactagaatgagcccctgccctccgtgagccaacgccaactctttgtccacatcctccacaccatccttcccagtggccccaggccacactgagcccctagcaccggaatgcctggagtcccactgtctgtgcagttcacgagctgctcagaagatgctgcctcccctagtaaatcacagcctcccctaaccgagaagagggctgcaaacagtgggaagttaaatatatatatatattttgtttaggttgttggaaaaagccaggaaatgcaaaggttctaaatgatgagaaaccagatgagatgagggtgatctttctttctgaaggacaggagaaattgactctgtgttcacaacatgaacagctaaccattagggaatgctggttgtaagttcggcattgctctacacactttacataccttattactatattcatcacaataaccctatgaagtagaaactattgttatcgttatttctacagatgataaaactgaagctcagagagtttaagtcactttccccaaagtcacacagctaggaagtgctaatcaagtcaggaagtctacatttttgagacagagtctggctctgtcacctgggctgagtgcaatggcacgatcttggctcactgcagcctttgcctctcgggttcaagtgattctcctgcctcagcctcccaaggagctgggattagaggcatgcaccaccatgcccagctaatttttgtatttttagtaaagacggtgttttgccatgttggccaggctggtcttgaactcctgacttcaagcaatccgcccgccttggcctcccaaagttctgggattacagacatgagtcactgcacccagccaggaagccccttctaaatcagaattctaacttggtagtttaggctctgaaccattcaaagaatcttaatttttaaaggaataaacacatataaaggaagactcattcttaaagaagggagttgcctttagaggtgtaagtattttgagtctttgtacatatacgctttctgtgtactctgttcccaaaagaagtaaaagttctaccacctaaaatttttttattggaatttacatctttattgctaggtaaacataagttacaactgaacgacttagtctcctttgatcatattttagtgtcagataccattttttttttgtttttcctaagtaaataattgtcttgtttgtttgcctagttttccatgtaactattagtaactcatcttcaagcttcttttttttattttattttatttttgaggcaggatctcactctgtcacctaagctggagtgcagtggtacagtcatggctcacggcagcctacggccttgaccttccccaggctcaagccatcctcctgcctcagcctctccagtagctgggactacagggcatgcaccaccacacccggctaaattttgtatttttggagagatggtgtttcaccatgttggccaggttggtctcgagctcctgagctcaagcaatccaccctccttggcttcccaaagtgctgagattacaggtgcaagtcgccacacctcaccaatatcctcaaattttctgataaaaaatatgatactcttctcagcctgtctaccacctaacatttagcataaatttattttttaaaagtagccccaatttattaaatacatgctctgtactaggcatagtgctaagtagcttccactatttgtaattttcacaggagttctattcgctaattatgagtcccatattccacctagacacattgagttttgaaggagttaagccatttccacttagcaagtggaagggtagaatgggactcgaatctgtgactgaccaatctcagaatccaaactactttctctaccccttcttaaaacaaaccttggcaactcagggcttacgaaattggcaagtccttgagaacacaactagtgaccatggtaaactacggaagctcttcaagctgcgttcaggctgcacactggaatcccatctgagtttcagaggagggggaagcttcctttctccaagagttgtcaggagtaactcactgttctgggcaatggtggccacagtgctaaatacagacggtaaactacactccttctggaaagaataaaatccagcacatacacgtgaaagatgatagctgctgtgtgggagaatggagtgaacacatgagttttaatattctgaatgtgtaaaaaaggcaatttcttattataagggcgttctgtatattctgtcagcatagaagagacaaaagggactaaaacttttaaaattgaatgtcatctacatttttagcttggatggatggtagaaaattgcttcatgaatcatgtggaatagatggaaagggaaagtggaaaaaatggaacaagtcccagctgtgaaacaaaaggattttgagtccatttcctgagttcagtaaaaagctgtgtgatatttggaggagtctcctaacttcttagcacttcaacttacttgaccataaattatagattataatacctactttataagacaaacaaacaaatacatgcgtgcaaggctaatgtggaaatgcattcactccacaattactgttcttaactcctacttttcatagtgctatacctctaaaatggttttatatgcattatttcatctaaccacacaatactataagacgtttaaagatgtggtgctagaatataaaattcccaattttaacatttgaaaacaggaactataattttaaagcatgtattataagaataatatttctttaagactattcttactattttatatttaaacacattcttttactgttaacttcaaattcactgcattgtattgtgaaagaagaattttaatgatctttctgactgtcagaagttctcttgctcattcttcataggaaataggtgctgttacgttcttgtttattttttctacacatagttatcttattgtgaaaggctgttttgcaagaaataggaaatctgcttaccacaaattctgataattagatggtgaaatgagacccacctaagatgattaaagagttagaaaatatggcctaagtagaagcattaacacagttacgctgtataatttttaatcctttttttaaagaatgggttgatttaacaacaaactgtttcaggtagctgccaataatatttctatctatcttaatttttttttttttttaagtcagagtctcagtctgtcacccaggctggagtacagtggcgctattttggcttgcagcaacttctgcctcctgggttcaagcgactctcttgcctcagcctcctgagtagctgggattacaggcgcgtgccaccatgcctggctgatttttatatttttagtaaagacagggtttcaccatgttggtcaggctggtcttgacctcctgacctcgtgatccacccgcctcagcctcctaaagtgctgggattacaggcgtgagccactgtgctcagcccttcatttcttatagatcaagaaaaactgagtttttattgctgcatgagatcaatagtttaggaataaagggtaatttttgataggatttatgtagtggcaacatgactaagctgaaagagctaggaattggaagacctgtatgaatgacctagctcttctgcttaattggtggcttgatcttggccacgttttcagatgagcctcccttgcttgtttgtaatgggaagaagctgtgcgtgcctcccacctcacctgttgtgaaggtccaaataagaaaatgcataaaaagcactttgtaaactgtaagggccaaacagataaagctgtttttgaatgagggaattggagacagaaatctttttttgctaaaagtcttcaaaagtaagtcagaatctcatttttctgggggtagttctagccagtcttttccacaagtagcaagaaagactaggggagcactgtcaacatttgtcatgagggggtcgggggttttgttctgcttgcatatatagctgaaaacttcaagactctttatgaactgacttgacaagatactccatcaccagccgtgattatctggtataaaagccttatggggatgttgctctttgtcctgaactctctctctcttttttccgactcctgtgtctggcgagtacatactcccttctttgtactatgctggaacaccttgctgtgctgcagtcatcattgttgaatccgacgtggcttccctcattcgtgcaataggaaattcactaattaatgactgtatgccagctgtgcctcccagccgctcttcaccctgccctgttgtacttgcacatccccattccttccctcccactgcctatctccacagcggaagctggacaccctggaacacctacattctaaaactgattttaagtctaacaggatgagaatgtcctactaggctacctgagaacttgatctataaactgtaccggtcacatacccccactctttcagaaattgcttgtattttattgtaaaaattattgttacagggttaagtgctgctaggaaagtcatgccgcaaggagagcaaacagccctcgtgtcctgggcatgtcctgatttcttccgcttcaatcggtgccactattctttttatcaagacctgaaattattctataatttccttccagcaccaaagatgctatattttgaaatatttttatctattaaattgcttttcattcagtaatatttttgtctttattaatcagatctatcaatcaaaattcatgatcagggtgagacaactatttgttaccacacatggctgataaactcgcagccagaagcaaacgattttgcggtttttcttagcctgggctgctttaaggagtgtaaatttatgaatctcaatttcactgtttggaagtatctataagagctctgttatggacggcagattttggttcccccatcctgcccctcttccacatgtcaaagacctgaccctccagtgagatggtgtttggagctagggcccttggggggtaattaagtttagatgagatcatgagggtggacctctcgtgatgggattagtggccttctaaaaataggaagagagagagatctctctccaaacacacgcatcaaggaaaagccacgtaagaacatagcagcaagaaggcagcattctgcaaattaggaagagggcccataccacaacccaacagtgctggcagcctgatctcagccctccagactgcagaactgtgagaaataagtatctgttctttaggccacccagtctatggtattttgttatagcagccctggctcattaagaggagcgctctcaatcctcttgctatctccttgcacccttaggattgagaactttttttttttctttgacggagtctcgcgctgtcgcccaggccggagtgcagtggcgcgatcttgcctcactgcaacctctgcctcccaggttcatgccattctcctgcctcagcctcccaattagctgggactacaggcacccgccaccatgctcggctaattgtttgtatttttagtagaggcggggtttcaccatgttagccaggatggtctcgatctcctgacctcgtgatcctcccacctcagccgcccaaagtgctgggattacaggcgtgagccaccgcacccggccaggattgagaacttccaacatgggaaccactacaacagaacaagacccttgaaacaggtttgtgattgtaattccttaatgctgaccatgatgtgtaaattacaatatgtggctttcattaattcaacattagtttgagccattctattcgattatattatcagtcaccatatattagttattctgtgggctcaggaaaatatgctaagtattttatttgtgtgggaaatatgttttttaagaccaagtatttgtaaatgttctcttttctgtaggattttttttcttttggatacaaatatagttaaagctcattgagaacctgcctgatggatgcttctatgccttgtttctaacagttccccaacactttaagaaactgaatattaaagaagatatttgtccagggccactcaactggctggtggtagagctgagatctgccttctaggttttatgcctccaaagctcctgaacttcaaagtagatttcacagtcactttagcaaatggtctgacccacattcttcccaaaattagatttactgctcaagtcaattggagtctttaaaaagttacttattttcatggcctagactcagacaaatgcattcctagtgaaactgaaggcctgggtcactgaggtattggcctttcagtcagcccaccatcgtggccaccacctaaggtggatgagttgtcatgcaaggagaatgaggagggtgggaagggttcttatgcttacccatgaagaactggggagattctgtctggagaggagagaaaagaacccatgcctttcagcaggaagagatatcttgtcatctgatatttaagtaacatttcatggccgggcaccatggctcaagcctttaatcccagcactttggggggccgaggtgggcagatcacgaggtcaagagatcgagaccagcctggccaatgtggtgaaaccccgtctctactaaaaatataaaaattagctgggcgtggtggcgcgcacttgtaatcccagctactcgggaggctgaggcaggagaatcgcttgaacccaggaggcagaggttgcagtgagccaagatcaggccactgcactccagcctggcaacagagcaagaccccatctaaaaaaaaaaaaaaaaagtaacatttcattaaggttcagcagtgattttactaaccataccctttaaccacacacacacacacacacacacacacacacacaccacacacacatgtaaaagagacttctggctctgccactttctagctgtctgacgtctgtttcagttttcccatctgtaaattggggcttaataattgtacctaatttttagagttcttatagagattagatatcttcatacagataagtcccttagaaagattcctgacacaataatgttggatattatgacagtaattattattttcagactgtatgctctgatgcctataaataaatatgccaatagaaatacatcctcctgacttttatttgacttggcccatgctgcaatatataatgtccatttactgctccattccctttgtaatcaccacttcccaaaataatgattccttctcatttgaggcgtcttgcagaaaacactggaatgagatttgaaatcacaatcaacacatccccaaagacataggttaaaaacttattgatccaatccagtgaacaaaatagagactactcaaatcaaagatggtgcaaagataaatgtgaaggtcatattaacacaaggaaatgttgccaaggtaggaaataaatatcaaccaaaaaatgacaacagcctggaaaaatgcaaactagaaaatctggagggaaggaagtgctgaaatataaaccaggaatatgcttcaaaaaagtctggtataaaatacaaaataagcttgaaataaagcaaaaaatgtatgatcttaagaactacagttaaggagacgtgaatgccttatcttataagcttcttaaaggcattgaatttgcttggtctttaacagatatataaatgtcatataatatcatacttgtttttaactatctggttgaggtatgacagtaggaataagtgttagaatcattaatctgtttttaattctgttttcaaatcttgtgcatgagtgtgcaggttagtgagcagctgggtactggtgtactgaccctaccactttttcctacacattttcatccagttaagcaatagtgggggaatctagcagaattcaaatcatcagctttatgacttgtaaattgaattagagcattcgattttggtctgcagactgcccactccccttttaaattagattcactctcctagtcccaggcacaactgtccatgtactgtctttgcagatggcttccatttcttgggctaagactattgctctaatcctggagtataagaaacatagtaaaacatgtcaatataggaaaacatagtaagcagatcatggatcttggaagtcagacagaccagaattcatatctggctttgctacttatcagttttatcatcctgaggaagttatttaaattcttcagacatcctattactcttctctagtatgcttgctccagatggaaatgtcagaatccaaaatccacaatgtaagcatataaattttttatttaactagatcaatttctgatgttaaacttttgtttggagaatgcatcttcactttgaactggaggcaaactattcactggaatagtctctttcctccaaattacttttcagagaacttttgttcttcctctcctccttccttcctttctttccttccttctttttctttctttatcccttccttttttcccttcttactctctttctttctttccttcctccctccctctctctttccttcctccctccctctctccttccttcctttcttcctttggaaaaaaaaaaaaagaaagaaaattcttgttttacaatactggtagaacacaggcttcgtcaggttgagggcttctacccaccatgcagtggtgttacagaccgtttctacatcttaaagttgtcaagggtgtcggggtggagaggagggacgcttgcctgagtcctcagtatccatgttatgggtgagtcaggtgttgactcatctcacacggccccatcctggtccacggctttggcagattctctgctacaatggggacaagatctttttgaaattgcccctacttccctctgccagctgctctttgaatccacactcacctggaggctcacagcctccaggaagcaatgccagaaatctggggctgggtttcccctgatgcaggacctcaaaatatatattcttcttttctgttccccttcaaccattgaagacattttttttttctaatttgtggtggggaaacagctcctttctcctatttgcagctccaagatgatactcctttggtgagctaattctcttgtacatttcttctgcttcgtctgaaaagtctttgatttcttcaaagaacttagacttttcttcctgctccctcctaagacattgtggtatcttcttgactgaaagaaacagacaggttaaaatgtgtgcatgggggtaggggttggaggaggagaacaaaacaaagcaaaacttacacacacaagttaatatctgagtacagcacccagttatagcacctgcgtgctattgattggagataaatgtgccctgtctataggacattagtaacataaggtatattctattagaaataatgcatgtaagtgatggatcatttttgttgaataatgtgaaaatcattacagtgaaaagagaagacttcagacctacaactgtgtttgtgtatgtgtatccctcgtgtctgtatatatatttagaatacttaaaacacattcaatttactaatggtttactgcttcccatgccctgtttgctgtacagctagtattgtgctaaatataatggtagatatgaagtaagcttcacacatgtaaaattctttcggagttatatggaacgactaggaaattatttgtcagagcagctttgacttcactctttaaaaaagtctctctgaaaagttgacacttttgtcaaaaagattcccacataatatgacaacataagagtaaacttgcactgatacagagtcaaaaataagaagtccttctacatgacttcaagctcccagtcagatttccttgtagatgactgactactccagaagaactttaaagaattctggcatgcccagtaatgaaggggacccgtccagcactgaaggaacaagaggatttctaaaaagggacacttttctaatgcgattcactgatctatttagaaaccatggcacaaatgaaaacatcaagtgtttgtgttagaaaactgatgaaccctgatgaacacaaataagtgatgttttcatgttttttttttttgctaagaaaaaagattatagaaaaatagcaggcaacccttatttgccaattagacacaaaatgaaatcaaaacccaacatttatagaaagaacaattaagaaacttttggccaactacaagttcaaagaaaataacaatagtaggcgacaaagtagaaataagtcgttttgctctgaaaggttatagttgaaagaaggtgactatctagcctagagatttcgtagaaattgtggcatagtaaactcacctaaaaagtgttacagtatttcaaattagctgctcacaaaagcgaaagccaagtctcatttttataaactccagtccttctgtccaagttcttttgtgttaactggattctacagtctttttttaaaagaaaacaacaacaacaacaaaacaaaaaaaacacttaatggattaaggttgcatcttgggatttagtcattttaatatgtggaacttctctcataattcttgatgaatgttctttcaaattttacctgcgtcatatttcacaaatattgattgcagacagcaaatgttgctcacttcttcaccaattgttttctcagactcaatcctcgttttagttgccactgacagactttgtactcacccaagaacattttagaggagacctagagcttttagttggacattttcttggaagcatctatctcttatgtaattcaagccttgcttgaaactaaatgtggagaaaacaaattacaaaaattcagaaagcattataattacaatgctgggggcattttattcccattaggaggaccatggatctctccttcctaactataacacctgcagatcatttctctgtgtggacttaccagagtccagtttctaacccgtagggtggagaataaggtacttcattacaaacctcaaatgcagtgtcaacatgctgagaccatttccctgagcacttgttccctacagcatgagagaaaatgaccctttaatgtgtattcagtcaaaaaaaatatatttgtattaggaatatttctctgagacttctgtgctgggaattaaagctatatctatatacgtaaaataaacaaactgccccgtggctggtctgctcatttcagctgtcttcatgatcaatgtggattgttgcacaatcgattcaaccacagcaatcagtattattcatgcactctaggaaacttggtgcaagtaaaatggctgggatgttggaaagtgtactcacttgttagatatttgatttaaggaattttgaaaaaatcgcattttatttttttaaactctcaatttaatcttttctgagtcaaaatgttggatccctagaataaaacctgaagtttgagataatcttttcaacatctcattaatgataatttctgtaaaatcttaataatttatcgtgagtcttctagtgctaaatatacacttaaaactcagagaaaaattgccatcataatttccaggacagtaaagcttgaatgtctagaaaaacagtgtgtggttcacagaaacttagattaaagtccagttggttaaaaaaaatactctttgcaaaattttctctagcatgtatcatacgcaaaaatgcccaatttggcagcttttctaggtagctttccaatcatcagtccggcagcaacctacaaggatttaataattcttatatctaggcttttcaaagactctttgtaagaaattttgattttttctatattgtaaatatcaaagagattaacttcccaagaagtcactttgtttagtaaaagccaactacaaacaagaggccgcaaatcaaagtatgttgtacagacatcattattggccacatagtgaaattctacaatatcaaatgccccaaagtaaattggattccaggtgaatttctgtgataatattgaatgcatctgccattgaaaagagacatctgtaggtcttcaggtgaaattgtttactaacttaggtcaatataatttgactaccaattgacaaaattgttctattggatatataaaggctatcctccaggaaagttaaatatctgctaaaattgcgaagattctgatatccaaaaataccatgaataccatgtgagaagcagagtctactatgaagaccacagaatatctgtgttgtcagttcatttcgactagaaatcagttgtattcctcgtggaatataaggaatatattccttcaaggcagcagatgttaaacttcttggtctcaggataccttttcactttaaaaaatattgagggcttcaggagtttatatatatgttgactatctctgtcaatatatagcatattaaaatttaaactgagaaattttttaaacacaagaatacacaggcacacgttccattggctgtcagagtgatcgcatagtcactcttcgtgaaacctctggagaacactgcgtgcccacgggagaatgagagcaacaatggcaaacaacgtctccttattaaaatgctttgacctcaccaaggccttgaaacagtattggggacccctaaacacgtctcagggacctgtttcacacatcatgagaaatgctgttccaaagactttttctcacttgtagaagctggataataataatcacaaagatttgtttgttacatatatgttgtgtaaatataaatgatcattactgagcaaacttcctaacctctccaagcatgagttccatcagctgttaaatggatataacaataccagtcttgagggatagcattaggagatatacttaatgttaaatgacgagttaatgggtgcagcacaccaacatggcacatgtatatatatgtaacaaacctgcacattgtgcacatgtaccctaaaacttaaagtataataaaaaaataataataatagtacctccaaaaaaaaaaaaaaaaaccagtcttgcacggtggttgtgaaaattagcattgatgtgtgtctaacccaaagtaggcacttacacattacaaaatttatctaatttgtttaacttctttctaactattaattaattatgaagcaaagctatgaaaaatgtataatctaggaaaggtttttcttcttatgcaataatgaccaaatgaagggaacacgtcaagaactatcctctggctattgttattctgatgcaaaatgtgctgctgaatgtttcttactagatacttacagaagcatgaagaacatttgtcaaacttagtcctgaaaaggtatggaatttgtggggcataattaaacatgaatataacatttcacacaaagtgataacactggaatgaaaaaagaactggggcttcatggagcatggagcatttgtggtgtatttgaagggagaggaggtatttgacgataagacactggtaggagttgagtgaagcacatttttttattattattattattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgtggtgtttggttttttgtccttgcgatagtttactgagaatggtgatttccaatttcatccatgtccctacaaaggacatgaactcatcattttttatggctgcatagtattccatggtgtatatgtgccacattttcttaatccagtctatcattgttggacatttgggttggttccaagtatttgctattgtgaatagtgccgcaataaacatacatgtgcatgtgtctttatggcagcatgatttatagtcctttggaagcacattttaagagaaagaaatcttcaaagcttgactgttggtcacaagtcaaggttggaggcacctccaagccctccaaatactagataaggatgagctgacagcaataggattgcatagaagttgtgttaggctcccaagtactctccctgattccatgcagtcatgggaaattgcttctcctcatcctggcagaagcaaggtttgctttctgcagacactcattcagagaagctgtgtgtaggtgtaaggcactgccccaggggagtgtcaggtgctgctgaacacagagggatgaaactggtgtctccatcctgaagagtgacagccctgtcccttgcacttgaaccctgaacactggcaccctagataatatcattcagggaaaagaataactcaaaaggaatgaaatttggatattgattttgggaatctaccaagaaaatgactggctccttaatcagtgtatagtgaggcccatcagtcaacaagctcacccaggtacagggagtttctgagaagttgtctgcatcttgttcttaaattttactagtgacctaagaaataaggattactatacatttgagaatagcttgtcatatgtaagatagggagcaaacctccccatactctgatagccagctgggtagctagctagaagactgatgataggtaggtaggtaggtaggtaggtagatagacagatacatacatacatacagatagatacatacataagtagatacatagattagatgataggtagatacatacatacagatagatatatacatacataaaaagatacatagattagatgatagaagatagatagatagatagatagatagatagatagatagatagatagacagatagaccgaccaatagataaaagagctctgaagtcagactgcttgggttgaaacattgtccctgccccctttgctaatcgaatgaccttgaataagtcacttaaatcctgaagcctcaattttccttatctgtgacatgaggataataatagttcctacctaataaaggtgaagattacatgaaataaagtatgacgtgcagactaagcatctaatacatattttcaacataattggcaaaaagtgcagggtatgcttgaaaaactccgtttttcggcttagttgaattactctgaacataaagtagaaagcgaagatagagccagatggtattttattttgactattacatactaatataacttaggctatgtgagagaattatttacagggaaaagtttactaaccttttcttcacctaagaaagttcccacgaggcactgcctcacaccttctgcccccaacaagaaacagtgcgtgactcttgagtacacagggtgtgaaaagctcataataccctaatatgtctctctaagtacaattggttgttcatgttaaattggaaacacttaataactgcaaagttaatatgtgattaaataacaacagcaaaaaacctcttctccctcttgcccaaataggggctcatagctctttcagtgtacccggggcccctttctcagcttcagaaggctggatattgtggcaattaattgtttaaacacactacgaaggattatgatgagaggaaaacataaaacataataaacacttggtaaccagtttatttcaatagcagctcctctgccaagccagcagatttttctaggacagagctcccttccataggcagctaatctaggacagagctcccttccataggcagctaatctaggacagagctcccttccataggcagctaatctaggaagagctcccttccataggcagctaatctaggacagagctcccttccataggcagctaatctaggaagagctcccttccatacacagctaagaaagatcaggggaatggccttcaatggaccccgctcatcattccctacacagtcgcaaaaggctcaccacctccttcccatggcccggctaaaagaaaaggtgttatgtttctttaactctttggagcataaaggagctgttttttttttttagtaagaataacattataatcaggtgttgtttaaaaatagcaacaaggcacaaagaaaacaggcattgacaccaagaaaaattagctgacaccacgtaataggagagatttattcatgaatgacggaaagttatagaacttcttttctttccttagcagcatgtcatcattgcaacaaagtcatggcaagagcacgtgcaacattaggttcaattgatctcagatccttcctcaccagtgtcgcagcaaattcattcttcaccaatagcttaagtctttctaggttcctagactcctatgtctcaggtggggttttttaatttatttttgtttttgttttaccccccaacattaatgttcctgagaggtgtgtttgttttgttttgttttgttttgttttgtttgagatagagtctcgctctgttgcccaggctggagtgcggtggcgcgatctcggctcactgcaagctctgcctcccgggttcacgccattctcctgcctcagcctcccgagtagctgggactacaggctcccgccaccacgcccggctaattttttgtatttttagtagagacagggtttcaccatgttagccaggatggtctcgatctcctgaccttgtgatccacccgcctcggccttccaaagtgctgggattacaggcgtgagccaccgcgcccggccgagaggtggttttttaattggtgagagggctggggggatcaggcaggggaggttgcagtggcattggagaagacaatgcctaggggttgattagttaccactactaagggcctacagattcatttgggaaaaattctatggaaaatcaactggaggaaggtttcttccttggggagggtaatgcagggtgcccatgtggacatgcatgtgagcatgtgcgtgctgtgtgtaggctccaattacccttcaaatgctaatcttctatgattttacacattgataccatgaccaaaacatgttaattacacatgtgcacagatcactggaaaatgtatatcgctgaagacttagtttcttccatgtctagagctcagtttattaatatgttgttccatataacaagttcattaatgttgctgatttttaacatttagaatattaatagttctgagcatgatattttgatctttcctcagagtgatttttgaaaatatgaaaaatgagaagagaagtagttacctattaacttgctgaagtctgacaggaacagttgaccagagtcccctgcaagggctcttgggagcactgggtaccgagcagagccttcatccttgttaattaaccgtccaacattgagacaggacttctgcttagaataaatggcttgttagaaaacagagctacacacatacacagaatcttttcattcacggataactgagtgttttagaaaatccagacttttctaagactttccaagttttaatttcaaatatattttccatgtttacattataactgaccatgtgtctaaatatagctagtctatactatatgtattctaattgcttgatatggagcctgcagctgagtacttgaatccagcattcacagagtgatacagtgtatgaaaaccttttacaatattttcaaacaaatgtaatgaataataatgatttaaaggtcataactcttagctattcttatattttatgacattcctctgcaaggcaatatgcattaaacaatggctaaacattaaaaatatgttttagaagattttaaaaataagaggcatttcagatctgcagaaaatcctcatgtgtcatattattttaaagaaatgctggaatgcaaatatgaattgacctatacttgattatctgttttgatttcattattcaatgtcttcacatggaagatcttgacagtccaacaattcgttttctgttctcttttcagatttttttttaatttggaaaaagaaaatggcattttatttcctgcttttatggactccaaagtcataaaattgtaaagaggagaaaaactgtcaattttttaaaggttaaatgcaagaaaattagagtgcctagaagagcagactctggattcagtgctgaaaggtagatagcgctggaaggcaaactcaaggctgagtattgaacaaaaagattgagcaagggtaaatatgcagaagcagccccggtgaaccattccagtgatttcctttgcccatgtagttgcattgagttgcactgaatgtgtgcagcctttttactgcatagtagaagaatggcaattgtgtttttaagctgaccattaactttagagggaaagctgccgaaaggcaaaattttccttcccttctgccctcaatttttcctctcaaggtgtaggatggaagctttgtagttaagaaaaatctcagtaggcctgtcagaaaaactagattctaattgctgagtgtagcagagctagcacagtttttaatgtttgcacagtagaattagttaaagcaagctctgcagatacaggtttccatgtggggaacacatgatgttctgaccgacaagttgggtgtttttagttccagacattgcttgaaacaatagacaccatgggtgaaagaaagaaagggggacttatcactgcagaacctggcacgcatgaagaggatttcccccggcccagtgaaaacatgggcctatgaatattttcaagaaaagattttcacttaactctctctgtaaaacacagttgttggggtgtggtatggtttggctgtgtccccacccaaatctcatcttgaattgtagctcccataattcccatgtgtcctgggagggacccagtgggaggtaatcgaatcatgggggtgggcctttcctgtgctgttctcatgatggtggataagtctcatgagacctgatggttttataaagggcagttcccttgcacaagctctcttgcctgctgccagtaagacatgccttcgcgtctcctttgccttctgccatgtgtgaggcctccccagccatgtggagctgtgagtccattaaacctgtttcctttataaattacccagactcaggtatgtctttattagcagtgtgagaatggactaatacagaaaattcatactgggtagtggggtgctgctgtaaagatacccaaaaatgtggaagcaactttggaactgggtaacaggcagaggttggaacagtttggagggatcagaagacaggaagatgtgggaaagtttggaacttcctagagacttgttgaatggctttgaccaaaatgctgatagtgatatggacaataaagtcctgaggtggtctcatatggagatgaggaacttgttgggaactggagcaaaggcaactcttgttatgttttagcaaagagactggcagcattttctccctgccctatagatctgtggaactttgaacttagagatgattcacagaatctggcagaagaatttaagcagcaaagcattcaacaggtgatttggtgctggtaaaagcattcaattttatgtattcacgaagatatggtttagaattggaacttatgtttaaaagggaagcagagcataaaagtttgaaaaatttgcagcttaacaatgtgatagaaaagaaaaacccaggctgggcacagtggctcatgcctgtaatctcaacactttgggaggctgaggcaggcagatcacgaggtcaggagttcgagaccagcctggccaacatggtgaaacccagtctctacgaaaagtacaaaaaaactagctgggtgaggtggtgcacgcctgtagtcccagctactcgggaggctgaggcaggagaattgtttgaacccaggaggcagaggttgcagtgagctgagattgagccactgcactccagcctgggcaatagagggagactccatctcaaaaaacaacaaaaaagaaaaacccattttctgaggagaaactcaagcctgctgcataaatttgcataagtaatgagaagccaaatatttatcaccaggacaacggagaaaatgtctccaagacatgttagaggtcttcatggcagcccctcccatcacaggcctggaggcctaggaggagaaaaaatggtttaacaggctgagctcagggcctggctgctttgtgcagtctcaggacttggtggctggcatcccagccatggccaaaaggggccaacgtacaactcagaccattgcttcagagggtgcaagccctaagccttggcatcctacctgcagtgttgggccttcaggggcacagaagtcaagaactgagctttgggaacctcagcctagatttcaaaggatgtacggaaattcctcaatgtccaggcagaggtgcactgcaggagcagagccctcatggagaaccactgctagggcagcacagaaggaaaatgtagtgtgggaggtcccacacagagtccccactggggcactgcctggtggagctgtgagaaaagggccaccatcctccagaccccagaatggtagatccaccaacagcttgcacggtgcacatggaaaagccacagacacgcaatgccagcctgggaaagcagccaggagtggggctgtaccctgtaaagccacaggggcagagatgttcaaggctgtgggagcccaccaggtcatcagcatgacctggatgtgagacatagagtcaaaggagatcattttagagctttaagatttgactgccctgctggatttcagacttgcatggtacctgtattccctttgttttggccaatttctcccatttggaatggctgtatttacccaatggctatacccccattgtatctaggaagtaaccaacgtatttacccaatggctgtacccccattgtatctaggaagtaaccaacttgcttttgattttacaggctgataggtggcaaggactagccttgtttcagatgagaccttggactgtggacttttgagttaatgctgaaatgagttaagacttcaggggactgttgggaaggcatgattggttttgaaatgtaaggacatgagaattgggagggctcagggacagaattatatagtttggctgtgttcccacccatatctcatcttgaattgtagctctcacaatgcccacatatgtagtgggaaacacccggtgagaggtaatggaatcacgggggcgggtctttcccacgccgttctcatgatagtgcatgagtctcacaagatctgatggttttttaaagggcagctgccctgcacatgctctcttgcttgctgccgtgtaagacatgactttgcttctcctttgccttccaccatgattgtgaggcttctccagccatgtggaactgtgtgtgcattaaacctctttcctttataaattactcagtttggggtatatctttattagcagcatgagaatagacaaatacaggctgtttcagagcttagtgtgtcctgctgatgcttgcacagtcctttggaaccatctgtgccctgcagtgagtcctgttccttttttcatattagctctgaaaccaccctttacaagtattttcaaactatctgaaaaacagcacttgattttcctcagtgttacagatgcaggaagccatcaaagtattatttgtttcaaagctctatgaatttttaggcaaatgtcactctatgaatttttaggcaaattcaggcaaaaaacaagtaaattctcatttaatatgccatatgtttctggtgcctaaactcctcttggagaataaaaggaacctttagaacactgtgtggcctcccacactcttcaaggcacttaccttactctcgaggaataacagagacatctaggtaatcttaattaattactactgacaggatgggagagaagtgtgtctaaggcacttatcagtatcatcaacagaattacatttagaaaatctgctctgtataggaaattgtgctccatagtgccctggggaaaataacaataacatatgacacactgcctgccttcaaggaaattattatctgggtgaaaataagatagacacctgtgaaggtaaatagcaaaacgggtggtatcagttacctgcaaaatgagaggtacgaggaagtaatccagaaaatcagagtagtatatcaccccagcattggaaaagacattaaaagtcttctagttcagtaatttactgatgcttgagttcacttgcaacataagagttcacatttattgagtattattattgcagacattgttcaaagtattatgaaaatacatattgaaaatatatgttcattgtttcacataacattttcatgagctgggattgtttacaaaggagagaattaaaaatcagaaaacgtgaataatttgtccaaagtcccatagtcactaaatgatagggcagtggttcaaactcaggtcttccctacctagagccagtgcccttcatcagtgtaagatagtcatgctggcctctccagtcatggaggcccagacaattcccagtggctcattccatcacagggagatggggagaatagtaagggtttcatagacttgaatgttccagaaagaaggaagtcaaaaagttaaaattaaagaaatactaattaatattttaaaaggcaaattccaaaccacacatgtaatctgtagaatgcagatttgtacacctttgagggaactcaactttcaactatcagaatcagtcctgggtagctaggatgatggtttgagaatagtgttatttttcaagatctttgcttctgtgaaattttaaaaggtaattgaaatattgagaagcctatgaagaggtgaatttaatataatccacagaatgacaaatgtacatttagaggatttaaatttaggaatgatgggcaactgatgcaatggttactattggccgtttgataaaagttctttggttttggaatttatttagtatccaacaacatcttttgctaaatctatagctctcccttgagttttatcttttctcttgttcattggtttatttaatttcaaagacaattacacacgccaaagtaatgatcctacagatgtataagtgtatcctgagatgaataaattatggacattttggtaattagcaaatggaaggggagcagctggatgcttaacacagatgggtttattggttaaaataaacttcagtttgcctttttttcaaattaagcaatattagccccttttgttgctttgtgaacaatcaaccaaacagcataattctagatggattgctctttgattgccattgctaaatctaattctaatgatttaattgtttttaatttctctgtggcctatatgtgtgggctgtgtccctgtctgtgaggcttaaaatctgaggaaaaacatgcttcatattctcatgagcaaagtattcatatgtgatctggattgtagctttgtgccaagcttcttctacaaatgagaatgaaaggaaaatttgtcgaatacaattttaccctcttaggtttttctttataagaaataacagttcagtgtgattatgtaaaatcattgggaatggggtgatccagtgttttaagaatacgtgtgtaaatataaaagatagaattattgattaaaatatccttacaaaataatcatgtcacttcactgcaccaaatggcgatggatcacccccttctataaaagaaaaaacaaaacttccttgacagcgcattaaatgtcttgcataatccgaccacagtcacactgacttggactagatattggggaccccaagtgatacaatgcatgcaaagattgttgaaggagccctttggatctgggttaaactgtgacccagcacatgctagttgagcagcctcaaacacgtgaattaaactgtctaaatgtggttttcctcactgaggggggataataatgctacctttcctacaaggtcgtaagactagatgaaatgataaaaagggcttagcacagtgcttggctttatgctccatgcgtgatctacttacctttcgtttctgtattgttgctgctgttgtaacttttattatctgacctctcatgcgtatttgcacctgaagatctgtctagagtgctcttttgtcatctgaatgatcaaattccataaatctttcaggactcagctcatcggccatctcttccactacattttgccagtcttccctagctaaaagctaattcttcttctataaaagcattgcaattcttattgtcagtgacagtcatttgtacttaatccttacaggcttctttaggtatttatctcttcatgtacttctcagtgagatagcagactccttaaaagcaggaactgaggcaatttctacatatcttttgcagtttctggcagaattgcaagcaatgaatatttgttgttttattattttttatccttcatggttgggaattatatgttgttttaatcaacactcaacaaatccagaatgcctcatcattagatgaaatggccagagttaaatggcaacctaatctgatagctcacatttattaaacattactgctaatgttttttatgtcccagacactggttctaagcacttcataagttttattttctttaatcctcttgcagacactatgaggtctgtattattttaattattttagatcagaagataataaagcacagaaggttcaaaaaaatttttccaaggttatatagtcagcttgagattgagccagggtttaaatccaggcagactaagtccagacagagaccatgctcttaacctctattcaattctatctatccattaatatattcagtcatcttcttaggttcttttcaactgggcaaaacccataaagctgagaaataactatggcagatgtcatttttcatccttttagggggcatattatgtaaatatgcctatttacataataaaaaatcaagtctatagataatgagacaaaatattttaaattaagactgccttggcaaaaatctgggtacaagatgaaaataaaaataggtaacacattttgaggtatcaggtattaggctgataaagtgaattttcatattttggttattactgctgagaaagagaaaaacagcctctggcagctgggagctagcttggcattatgagctgggccttgatgttctcctgtgcacataaactatttcacagagcatcagcgttagcatcagctaggaccactctctgaccaggatggatccaggcaaaaacatcaccactccagaggcatgtctgaacccagacagaaacaagaacattttccaaaccacaaaattcaccaaacatcctcttatcctggctaaagtgagaggctgctgctgctttaccagtgatagctttagccttctctgttcctcctgtcttctggatgagaattattaagatactgagtcacaaaaatgccactgctcctgaaaagcatcccatccagaacaaagctttccttctttgagccttttcctaaatcacttaggataaaccccaattctgccagttctttctaatattctcttactgatgtggcccccagatccccatgatgtgagttgccccgcactggaacatttcaataaaccagttctccaactacaagtttcctggtgctgtgaatctggagagcattaacactattattatccttatctcagcaatgaaggaacactgagtaaggtcaaaactactgtttgattctatatttaaacccagtttgtctctattgctgtcattatttttgtttttgtttgtttttattacgtaggctccggaaactgctctcttaaccactacgttatacagctcccttatggttactgcaaacacagataaataataagatgagaggaagtgaccgtctactgcattactatcacgtgctacctaaattgatatgtttttctaatttaaatctcacaaccctttcaagcaacaatccttcttttacagaagctcatttcagctattaaagaagtccatatttaaaaatatgaagtaatttccctttataacagaagtctcatgactagcaagttttgaattttaattccactgtctcaggtaatatactcacatgcttacaccacattggaatagttattatctggaaaggagctgaagcaagcactgtcttagagcatcgtctggtctggtattgctccttatttcttggtaaggtccagcaagaaacacatgatcagaatgcaccttctttatatttccaactgctgtttgttctttatcacaaatattagaattggggatgccttatctccttctttattatctattgagattgactcgattttgagagtaggtcaattatcacgatagaacttttaatcttatacatataatggctctgactttaaagtttctaaaagaaaattgagaaaatataattaaatgtatgtttcagggaatggggcctgtctaacttatgatatcaataaatgctataataaattatccttattctaaacaattgctgccagtcctctgaactatggcatgacgataactggagtatcttgggatcctggggtgcttctatcccaagagtatgtgaagtcctgtttcatttattttatatttttctataccaaaatcattttccgaaagactacaagaagaagaaaggaaaacaggaagacctaccatctcagactcctcatttttatgtgataccaactttcaaaataagttctatttaggtgatagattgtttggtgaaaaactacttaaaactgtatttgagcaggaattctttgtgataccaaggaggactagatagatatcaagtaaactcctgatttagagatgagaactagatagatattattaagtcaactcctgatttcagagatgagaactccatagatattattaagtcaactcctggtttcagagatgagaactccatagatatcattaagtcaactcctgatttcagagatgagaactcaatagatagcgttaagtcaactcctgatttcagagatgagaactcgatagatagcgttaagtcaactcctgatttcagagatgagaactcgatagatagcgttaagtgaactcctgatttcttacagtctctgctaatctgctcactagcatggctaaaggaaatgttgaaattttaactagaaagaaagtatttgactatttgaattttcatactcttgtttaaaatgaaatagtagtaaaacatttgggaaatgtaattaaaattctggttctaaacatcttcatgaagatgacatcattagttatgccagaattcctggactgatttttcagattaagtgttgtcattaatgggcatcaatctgtattgaggaggttttttttcctgaaaatataaacattacatacattatgagtgacaacaaatcttcatgtcatatagagaaccatttacacttcatatctgtgaacattcatgtatatattgaacaatgtaattcttaatgaaatattgatttctaagtgccatttacttataaaacttgagtcatgatttcagtttaagttggacaacaaactccaaaagaaaccctgcagccagtgtgtctcatgttttaggaagtgcccaggcagctatgtggtattttttccaacacagagcactcaagatccaggtcctgcagatgaaatttgtagccttaataaacatatagggttgttgaacagtaaaggggtttatttgtacttttatgagtacatttttctcttttgtttactaatgaactaaaatttttctgcatgaaaaagctcaatatagatgtagaaatcttttagagacatgacaaaatgtactacgtcagagccaccagtactcacgttaagtagacagatcacacagacagcgatcagatttcacgttcaagagttcatcttgagttaccgttctatagactcagaatgaagatcacctcgcttattaaaggcaataaaagataaagaaaataggaaataagaaagacttgattaaatggccatttcactgaattcagcatgagtcctgcacaaattagacatttagattaacagcttctttgattattagaaagcctggaaaatggggtctgacaggattatagcataagctcatttataatgattcattttttggaatgtagctttttcataagccaaatagaaattacacatacaaattcatatttggaattttgttcttatttttgaattttgcctatcttttcaggtgtctgtgaactcaagagaagcctttcattctagacatagtagttattttctaaatcatctttaaacttatttgctggaatattgtgggggtaaagtgcaaacttccccttcaccatctgaaggtttgctaaaaatcaacaggcagaaggcgaattaacaggagaaatggcatgccaatttgtttgatcacagttttacatgaagaatgaagacccaaagacacatgagaaattgtccatttttatgcaacaccagaccaggcgatgctctaagacaggtacaacaaagtatggacatgcgtgtagaaatacgagtcaactaaagggtgtgatctactgctaataggctgagtggggacacccagactcttcctggcccctgtgagcagcttcctttccttctggtgtggggcaggaacttctctggaatggggatcttctgacccacagtcaaacaaggtaggtcacagtttctttatggccagttcttacacagaatggtgggggaaagttagaataatattcttaggttttatggctgtctttgggagaaggggttttggtttctctgacgcaccttagggaaagaaaatttctagtttctctgtctagcctcaagagagaatgaggctcagagacataagggcagaagaaagtcagggagggttttttgccactgagcttgcttctgaggccatctctgaggccttcactttggggtgtcattttatgagccccagcaatatctttctaaaaaatatggaaaaggcttaaaagactcaggccattttagagctatataaacttgtataactaagaatggagaattgttactgaaagatactaggtctctttttatactaaatttataatacagtgtagctccctcagaaagaaaaagtgaggttcattcattcatttattcacttactcattcacaaatgtttgttaatcacactagtctcctctcaagtaagtgaaagataacatataatatacataacaggccgggcgcggtggctcacgcctgtaatcccaccactttgggaggccaaggcgggcggattacctgaggtcaggagtctgagaccagcctgcccaacaaggcgaaaccccgtctggacaaaaaatacaaaaaattagccgggcgtggttgtggcgggtgcctgtagtcccagctactcggaaagctgaggcaggagaattgcttgaacccgaaagattgcagtgagccgagatcgcgccactgcactccagcctgggagacaagagtgaaactccgtctcaaaataacaacaacaacagcaataataataatatacacaacaaacatattttgaaggtgataagtgcaacaagagaaaagagtcgaacaaggggaatggagactgcagggagtaggggagggatagtatgagtagaagttcattggtgtagacaggataagcctccttgagaaggcaacactaaaacactttttttttttttaaaaaaaaaagagaaatttctgtggggacatgaaaggtattaaacttgtacatagaggcagcagccagtgcaaaaactctgtaggaggaatgtgatcactccaggaataagaggggtccatgctctgtgacaggacaagaagagggcaggaagaaattaactggagtgatagagcaaggctgaccgtgcaggatcttgcaaaccactgtgatgcgaagtcttgagcttttaattgaagagaaataggaacccactggaagtttaagctgagaagtgacgtgatcgctgctgaatttttggaggattattctggttttgtgttgaaacttcagtagatcaaggctggaagtactggagaactgttgagaggccactgaaataatccaggtgagatacaagggtggctgcaccaaggttgtaactgtggagggactgatatgtaccaggtcttggatacatttaaaaggtaaaagcatataggttttcctaaaaaactggatatagaagaggtaagaaagatggaggagtccatcatttggcttcaggaacaagaagaatggatttgccattaactgcgatgggtaaaactgtgaaggaaagcaaaatatttcacccaaaatatatttctttggcatgcttcaagatggctattcagagaagctgcaaaccacaggaacagatttggaaagttgtcttttttatggaacgtttgcacatgtagagaaaaatctacagcaaagtaaatagcagatacaaaaagtctttttctaagcccacccttgtccaaatgtaggaaaaatacacaggagagaccaaaagtctaatatttttaagagtctgatgacaggcccccatctattctttttttttttttctttttttttaaagattgcattttgctatgttgcccaggcttgtctcaaactcttgggcctccagtgatcctcccaccccagcctcctgagtatctgagactatagccttgcatctgttctttttgagagctagtgcttcatttgcataacaagatcagctctgattgacaacatttcctcccctcattctcccatagcctgtgaggctacctccctggagctcacagaaactttgtcctaggccgttgttctttgggctcattcatttcccctgaaaattatttacttctgcattccccatctctgtcctccccagtgaagagggcatttaagccagacaaggacaaaataaaaaaataataatggccagtcacagtggctcacacctgtaatcccagcactttgggaggccaaggtgggcagatcacgaggtcaggagtttgagaccatactggccaacatggtgaaaccccgtctctactaaaaatacaaaaaattagccaggcatagtggcaggtatctgtagtctcagctactcaggaggttgaggcaggagaattgtttgaaaccagaagctggaggttgcagtgagctgagattgcaccactgcactccagcctgggccacagagtgagactctgtctcaaaaaaataaaataaaaaataaaaaaaatcacaagccaatatcattgatgaacttagatgcaaaaaccctcaactagttagctgaagtcaacaacacattaaaaagatcattcaccatgattaagtgggattcagcctaggaatgcaaggatggttcaacatatgcaaatcaataaacaggatacatcatattaacagaaccagaagcaaaaactgtatgattatttcaatagatgctgaaaaaatattcagtaaaattcaacaattctttattataaaaaccctcaataatctggatagaaggaacacatcccgaaatgataaagactatatctgacaaacccacagctaacatcatactgaatgggaaaaatttgaaggcctttccccagagatctggaacaagacaagaaggtccactttcatcatttttattcaatgtaatactgcaagtctgagccagggcaattaagcaagaaaaagaaatgaagggcatccaaattggaaaggaagaagtcaaattagacttgtttgcagatggcacaatgttatacttagaaaaacctaaagactccagcaaaatcagttagaactgataaatgtattcagtaaagttgcagaataaaaaatcagcatacaaatatcagtaacttttttatttttctgaggcagggttttacaaatgtcacccaggctggagtgcaatgatgtgatctcagctcactgcaaccttcacctactgggatcaggcaattctcctgcctcagcctcctgagtacctgggactacaggcacacgccactgcatccagctaatttttgtatttttttgtagagacagggttttgccatgttgtccaggctggtttcaaactcctgagctcaggtgatttactgcctcgcaaagtgctgggactacaggagtgagccactgcatctggtcaaatatcagtaacagttttatatgccaatagcaagcaatctgaaaaagaaatcaagaacacaatctcatttacaacagcttcaaagaatataaaacacctaagaattaatttaagtaaaaaagtgaaagatccacacaaggaaaactatgaaatactgatgaaaaaaattgaagaggacacgaaaatatggaaggatatacagtgctcttggattgaaagaagtagtattgctaaaatgaacatactcaaagtaatttacagattcagtgcaatctctatcaaaatatcaataacagtctttacagaaacaggaaaaaaaatcctaaaatgtatatggaactacaaacacaccaagtagccatggcaatactgagcaaaggaacaaaactggaggcatcacattccctgactccaaaatatactacaatgctatagtaaccaaatcaacatggtactggcataaaaactcatgcatgcactgatggaacagaatagagaacccagatatcaacccacacatttacaaccaactcattttttacaaagtcaccaaaaatatacaatgggtaaaacagagtcttttcaaaaatgatggtaggaaaactggataaccatgtacagaatcatgaaactagacccctgtctctcactatatacaaaaaccaaatcaaaatggattaaatacttaaatctaagacttgaaactataaaactaccggaagaaaacaatggagaaatgctccaggacattggtcagggcaaatattttttgtgtaagatctcaaaagcacaggcaacccaagcacagttagagatacagaattacatcaaactaaaaagcttctgcacagcaaaggaaacaatcaacaaagtgaagagacaatctaaaaaataattaaaaaaaaaaaatttgaggccaggcacggtggctcacgcctataatcccagcactttgggaggccgcggcgggcggatcaagaggtcaggagatcgagaccatcctggctaacatggtgaaaccctgtctttactaaaaatacaaaaaaaaaattagccaggtgtggtgatgggcacctgtagtcccagctactcaggaggctgaggcaggagaatggtgtgaacctgggaggcagagcttgcagtgagctgagataatgccactgcattccagcctgggcgacagagagagactctgtctaaaaaactaaaaaaaaaaaaaatttgcaaactacccatgtgacaatattaataactagaatatataagtaactcaaacaactcaacagcaaaaaaaaaaaaaccacaataatccagtttaaaaatgggcaaaacatcttatcagttagttcttaagagaaaacagataaatggccaacaggtatatgaaaaaaatgttcagcatcactaatcatcagagaaatgtgatctaaaactgagacatactctcatcccagttaaaatggcttttatcaaaaagacaggcaataatgcatagtggtaacgatttagagaaaagggaaaccttcgtacattgttggtgggaatatcaactagtaccgccactacagacaacagtatggaggttcctcattaaaaacctaaaaactgagctaccatatgatccagctccattgtactgctgggtatttatccaaaagaaaggaaattagtatattgatgacatctgcatgcccatcttgattacaacactattcacaaagccaatcaacctatgtgtctatcaatagatgaatggataacaaaaatgtagtacatatacataattaaataccattcagtcataaaaaagaattctgtcatttgcagcaacatggatgaaactggaggtcattatatcaaatgaaataagccaggcatagaaagacaaatatctcatgttctcatgcatctgtgggggttcaaaaggtaaatctcatgaagacaaagagtgtattggtggttaccagggcccaggaaaggtagtggggagggaagtatgaagagaggttgataaatgggtacaaatatacattctgacagaagaagtaagacccagtatttgacagagcagtagggtgactatagtttacaataatctaatgtatacttcaaaatagaagaaaataatttgaatatttctaaaataaagacaaatatttaaggtgatggatagttcaattatattgagttgatctttacaaattttatcaatgtattaaattatcacgtgtcctgaaaatatgtacatctattatgtatcaatacaaaaatttttaaaaaactattctgtacaggacaatggtctaaacacttggaatacaggattgacaaagccttctgaaatttacttcagaggaggaaatatatagtaaacaaataaacagcaaaatgaaaacctagagaccatgtgataaacagtatgaggaaaataaaactgagtcttatgatagcttctaatggagcgtcattgagtggggtgttattttaggttgagtgatgagcaaaggccctcaaaagatcacattgaactgaaacaatattgtcctaaaaaagagtaagccatggcaaattctagagaaaaagatttccaagcagagaaaatagctagtgcaatggtctggaggaagcaagaagctcagtatatttgagaaaaggggaggccaactgagctctggcacagagaatggaggagggtgataggagatgaatttagggaggcaagaaagcacccaactctgcagtggcctgtgggctgtacaagcattttagatgccagtccttggaggagtttccaggctgtgataagaccttatttgtgtttttgacagaattggacagaagtcacatcagggagaccagagactagagtattgcatcatagaggaaagacactgatgacaagacctcaggggagcagtggaactggaggcctgggagcttgggacgtgttctccgggtgaagttggctggccagctgatgacctacaccagtgccattcactcctcatgtgtcccccgggaattcatagtgtgtgtcatcaggtaaaagcaacactactttcagatgttttctgatctctttgagatctggacaacactactgtgtacatatggccagcaacaaattacactcaatgaatattttagagagcagcaaagtaatcaattaaaatgtgggtaaacaaaaatcactgtgatcacagctctgtctacatggttctttggtaaaaaattagaatcctggggattagtctgaggataaatattatttaaaaagcattttggttaaatagtaattagtaaattttgctctgccgaaaaatcatatatattgacaataaattttgtcaaatttattaataaccagtctgaaactctataaagatgaatcctcaaaatatggatataaaagaagggtttagttttgttttattttcagacagctatttttaaaaaaatagtaaaaatgtcaaaacaatctggttttattttattataaattacaaagaaaaaaatacttccctttttgttgttgagcttatctattcacaaacacagaaagtagcaaaagaggtttttgatagcacgccatcccccatttaaaatacatttaaagacatccaataatcatcatcatttagaaggaatccatcaaaacgtttcctattaatactcattttattagttcagctgaatggaaacagtagcatgcttacatttaagaaagttcattatgggttcgttttctttttaacaagaaaggggaaacaaaataatgcccaaacacacagtgttgctggagtcaaaacaaagaaaattcatcaaagcatctatgagagctatcctgggataatctattctagagaagacaatacaaattggctgcaattgacaggtcgtaagttcctgggggaaagtcattataagcacatcatagcacatttggccgattgctcagtgttccacacactgacatcaagaacacatttccaatccatattctgattggttaaatgtggtttaggcagcctttcagctttcagagaaatggtcaaattctttcttttcaaaattcccaggccaagtcataataatgtactgatctcatggaagtattcctgcagtaatcacttcgagttccttcgttgtgcctccactgctctttcattcagcaattgccgttttgtgtgttatcatagaagaataacaaagaattagactcatgactctgaacagaggcttgctttttacatgagtattattatttcatccttggaaatcctggaaaacttcttactattttggatactaggtccagagtctgtttgtttacagcatggatgctgactggttgcagtcagagggtgatatgccagtgcgtgaaggaaatagggcaaaatgtaaacattgtacgtttagtagtgctctttctgcaggcaaggagagattgattgatttctcaagtgcaacttgtctgggggaacatgggattttattctattttatttcatttcatttcatttcatttatgtttgagacagactcttgctgtgttccccaggctggagtacaatggcgtgatgtcggcccactgcaacctccgcctcctgggttcaagcaattctcctgcctcagcctcctgggtagctgggattataggcgcacaccatcatgcctagctaatttttgtattttcgtagagacgaggtttctccatgttggtcaggctggtcttgaactcctgacctcaggtgatctgcccgcctcggcctcccaaagtgctgggattacagatataagcctctgtgcccggccaagcatgggattttacaatagcatcgtaagaaattctatctttttccctgagtattcaatttacacccatgtttcgaatgagcagtgagcaccagcacggagatcggagccccgtgttacttgtacgtgaaggtgtcagtgcctgagtgtgctagtgctgctgatactcacaccaaatagcaaacaagagccggcaatctaacctgttaaaaataataggcaaatgggaagagaggactgaggaatctccttgaagtttcccttcactgatgggtgctaaagatgtatgccttggggttttttagatgacatcgatgtaatccccttcaaaaatagtgacggaagaacagacttcttcaccttattaatttcctgcggcatcaaagtccctttgagagtctttctgttccaatttttcctcaagttcacaaaatgttggctgtcagcgttattgtgggttaagacagaaggtcctcctttcctgaccccagagatcccagatcatcccagtgtttgtttattttctaaaatgtccattttgcttagaaataaacacaaattggtgacatttattccttgcactatcttctaacaatttattctaggtttactaattctcatgatgttctgctagagaaatatgaagaggcaatttacttgtgtagaaatgtgagtcaaatcaagtgaatattatcattgtcagattcagcatttatcagtcttccctcacaagattcagagagttctttttctgttcagtttggtaataagagaagttataatcaatttggtcataaaaattgtgcaaaattagatttttttattccactttctgctatgaaatattcttttgtttgttagtttgcttgagaccgtgtctaattctgtcacccaggctggagtgcagtaatgtgttctcagctcactgcaacctccgcctcccgggctcaagtgattctcccaccttggcctcccgagtagctggggctacaggtgtgcaccatacgcctggctaatttttgtatttttttttttttagagacagactttaaccatgttgcagaggctggtctcaatttcctgggctcaagtgatcctcctgccttggcctcccaaagtgctgggattataggcgtgagccaccacgcctggcctaaatattctttaaatatgtgtgactttggaggaaagggaatcggatgggttaaaatatgtgaagttcattgtcaactgttatccttgagaaatatttaagcttcccttaatgttgtgtcttaaatgacacataataatccaggaagggatttttatgaccataatgggtttttagcttaattttaggtagcaaagagaaacatctgctatggaaaaagcttaattgatttttatctgatgtcacgaagctgctacgaggcaccatcaccagcaggtgggtgctgattacgccctgtgccgaggactccgttttatgaaaaacatcaatcctgccatctaagaggagaagacatgctcaataagtttatctctgcctccctacccatgttcaacaaggtatcccagaagaacttaaaagctatttactctggattataatagatcctcttgacattctgtaactggtgaagccatgggagagtcctggcttaattataaacaaccacaaagttatcatcagtgctacctggctacaaattgtttcttgcagagaaaatttttagctatttaagtcccacgaaagtaaatttgggggctgaaaatttttaataagtatttaaacagcagaccttcaatttctctagacccagtgaaaacagaaaacaggatggagtatttgcttgccatgaacctttcctcccacaacaactgtgcattttaggaagtcagtagtaactagcttataaaatacagagctctggaaatcatatgcctcatcagactgtagctaatggggaagacacactacttcctgtatttcaaacaataaaaaccatgatgtaataaagagcaagtttatcctgaggatagaaagtagcccttacataaatgagtaaatcagtaaaataaaacaaaaagtacccctcaacaaataaaatacttttctttaaacttataatttgggaaattatcttaatgttaatcactgcttaataatttttaattagcatctgcaaaaatgtaatttaattttaagttagagatttcttggtactttaaaactaattaaatatttaattatgttgtttgatacccacatattacataagaaatgtcagtttatttgttaaatgtctcacactgaaaatctcggttagcacattcttttgagttttatgtttttaaagcaatatttgcaaaagaatttctcaaaagaagtcagtactgtttctggacagttcatgaatcatctaatggaagatcttagagctgatatttgtaccagaaaagatgttacacctaaaggtgctcattactttattcaatggacaagagaaataaatattatcttacaggtattatagaaatctttatctatttcactttctctccctgtcctagataaacccacacacacacacactagcaatgtaaaatccaaatatatttttattcaaacacgttaaatcaagcaacagaattctagtacagttttgctgtattggtcatgtctggcatacaaaaaatgtttaagtcttcaaaattattctggtatcatatctgtgatcccaatactcaactgggtttctataaatataccagtaaatattcgttggctactaactaggtgtctttttttgtgctaagatttgtgaaggatgagaaagtattctggagaggcatactaaacattataaacacttcctgataataatttctaaagcacgatcagagctgtccgtcatcatataaagatggttaaaaaaaaaaatccgccaggcacggtggcttactcctgtaatcccagcactttgggaggccgaggcgggtggatcacgaggtcagaagatcaagaccatcctggctaacatggtgaaaccccgtctctactaaaatataaaaaattagccgggcgtggtggcgggcgcctttagtcccagctactcgggaggctgaggcgggagaatggtgggaacccgggaggcggagcttgcagtgagccgagatcgcgccactgcactccagcctgggcgacagagcgagactccgtcttggaaaaaaaaaaacaaaaacaaacaacagcaacaacaacaacaacaaaaatcaccccataacaatatgctacaccatatccaggtgagaaaaatcaacaatgaaactgattttgcaaaattccactgtgccttctatagtcatcttcaaggtctggggttattgacatgctgggagaatgaacctgatattctgtttaatgactcagatattgtagacatatttcagacacagaaaaactactataccaatacatttaaaaaaaaataaactgtattcaggatttgtgatttttttaggcccatcaagagcaaattataaatttatttcaataaggattgcatgaactttgtggttttaaaattaagcttttatagacctgcttattaagataagcatattcatccaagattaaacataatatttccagtagaatctttgctccatctgaataatgagttaaactcagaattatagcaactttctgtagcatttctgatcttaacgcatgcaagtagatatctctaaaatatatttgaaatgggttagggacctttcattatggaatggctaggcagaaaaggactatttttgttacataccatttcctccctaacataatggtgaaatacaaactttaccaggtcgatttttgttatgcgggaaaccagtgtttctgcaagataaaaatgaggaactaattgtttatattagagccttaagactgatgctattttatatgcaaatttactagagcaatttgttttacatgtgtattacgtcaaatgaatcaaattgtctgaatgggtgaaactacgaatatagaccatttcattctatttgaaaataatttgcaattccgcattttatacaaatctaattgaaatataatcatgcctccgtaaaacagtgataaacttaatatatgagaacagttgttatgtgccaataaaatatcaaaaccaagcaaattatagaatagttatcaggatgactgtaaaataacataactagctctaaagctgagtcaaaaataattatttccgctgtaagaagggccatctagtagaacaaactacattttctgactgcagattgtttctttataaaatgacaatagcagattgtatcgagttggaccgtgcatttagagttcagaaggctcatgattacctgagccagtgccagcctcaattctcaggcccacgtgcaggactaaatggtttatggcctgcaacaaaaaggcctatggccatttaggaagtgaggtgttcggttatcgttgcagtaaaagaggtaaaataatcttttttgaatgataaagtcacaagtcattgaaaactgtgtgcctagttattatcagctgtttttctttcctcctttgactctttgtggtcagtgctaatgtaagtctttgcttgaacaagcctgcagtgcaaaaatggtttccagcagtgactggcagaaccaggaccctagacagttgcattgcaggaggaatgagaaggcatcacaaaatagaaagttctaacaccctagatggcattttgtgtcatcgttttctgtaagtgcctcttaatactcttggttttgttttgtgttttttttttttttcactataatctgttctttttcctttttttttcaattgaatctaacctaaatatctctatgagaaacttttgactcattaacaagataattaaatgatggagcagagtgaatacttttcactgggtgtcctatagtttgtaaatgcttgccctttcagtgagctttgaaatatttttaagtgtaacagtccttggtaatagctttacaatggggtgcaaatacagaagtcagtttacaagaaatttctgttctctttatattcacgcatctgagtccagaattctaaaagactgctcatcatcctacctataatacaaacaaggtgccctccatgttaactgcagaatcctgcagttacagtctagacacacgaaccttgcagaagggtgcatcggttactttacatactttgcataaacgaggtactaaaatcctcataattatccacctttcagaacatgtccgactcaaaatattggaagaacatttgagaagaatctacaggctagaatctttttgaatcttttcttttgcttgtttgttgtttgtttgtttgtttgttttcagttatttgggactttaatgttcctgagacaagaaaaggaaacatggaagcacgcacacttagaaatgagtctcagaaacggaaaatccaaccagctaaatcatcacagcactcctggcaaaattctctaatgataaaagttgtttgttttgttttgtttttctgatttttcttttcagacacattaataatctcttgactaggaaaggggaacccacaaaataagtccttcttcattcttgtgtgcagttaattttgtttctacatgtgtctgcaaaaggcaaagatgacctccaaagcagattctagctctatttggatgagtctgtgagttttggtcaatgaaaatgggcagaaatcctgtcacaggagagagctaagtagacaacctcattggaagttaaaaatgtatattgtcatgtcaacgcaaggaagcaattataggcctcatgccaactgcacatcgtctgtgtgagtccacgtctccaggattccgagtctgtgtgagtaagtgctgttcccacttcaggaggagcagtggagacaattagtaggaatgaagtctccttggtgtcagtaatatgaaaaaatataccatgatcaaataagcatgtaggaaaacacctacattttcaaattcaaaaactattggaaaacattaaactgagctttatgtctttacaatttcttttcatagcaatgcccagttaatgcgccattccacactttctgatttatcttcagataaatgagcttcttcagccgtttgcctcatgtgtcctccttgcccttagtagagagcagcacataggatgttttgatagactttgtttgtggacaaatacaagcaaagcagcaagctgaggaaagccatcattgcttttaatattttgtaaacaataggacttgcttttatagtcatattaataaaagcaaactattcttacagttcagttaggctaggattagaccaaaacaccaaacaaaacagctgaccttgcaatgaaaatgtaggcgaaaatcacgaatttgagaagagatgtttaagaaatatttttaaaataaaattgaaaaaatggaagagtaacttgtagcaagtgctctagtaaaaacttcctctgtatacacgtttgaagtatacagatgaacccagtagaaagagagcttggaggtgacgggagaaacctgattattacgataataataaggtcctaatgagacaggaagggaaagatcgaggggctgattgagcaggctgttggtttaattcttgcttctgcagccattcccatcttctggaaggaggcaaagaggttggttgtacatattacagtccataaaccagaatctatctgagagctgtcagccaatagcccattggaaccctaaagacccctaagtcctagagctagatataaatcctttagaactatatcagaaaaaaaaaactttcttatacattttctccatgtgagaaaaacattattatgtttgtgttttagcattggtttcacatctcaaaactttttgctaacatatggagtttgctttagttaataaaattaagtgttttttttacattaccagatgatataaaattcagcaaatacttttttatatagaaatggaaattatgctgtgttactatgtgaaatattaactgctcctttagctattcatctactggctcgggatgactcttattttaaatgctaatttttcagaatctttttgaagggtgttatatatgttattttatcacatggtcctgtgagatttgtatagtgtccataaaattgtgaagtgggcataggtttttttaagtatgacatataattaggattaaatattcacatgattatagggctattcttgcagatataaagccaggcaaattcccaatggataatacttcaagaaatatttgcatccttaacattaaatctgtcttactaagttaactttaaaattgctctcatgaccaattttgcatcctaaaggtaaataaataaataaatcaaaacatgacctaaaacataactaattgaacaagagaaaaaagtgtagaacacaaattattgatttcattttcatattttaactagttgttctttcattaataagtataatgtatatacaattttcccactgtttaattattcaaagattttaaaactgaattgaatacttcatgaactaaaaattataaaatctttattcctgaatagctggaaaacaaaacaaggaactttgtcttttttaatggcatagttctgtattaccttggtgactctaaactctatgctttattcaatttttttaattgttggagacaaggagaatcataatctcaacctgcatttacatagtgctggaagaaaagaccgaccgggaatgtgtgatctgtcacttggctttggaaacacttgaagaagttgcactaatgtaaaaaagaaacagaaagatttaaatctatagaatatactcattgcataaagatgaattcagcaaatatattgttgtgagcatcttctatggtgcagcgccaggtcctttatttatttatttattttatttatttatttttttgagatggagtctcactctgtcgcccaggctggagtgcagtggcgtgatctcggctcactgcaagctccacctcccgggttcatgccattctcctgcctcagcctcccgagtagctgggactacaggtgcccaccaccatgcccagctaatttttttgtatttttagtaaagacagggattcaccgggattcaccgtgttagccaggatggtctcgatctcctgacctcatgatccgccctcctcggcttcccaaagtgctgggattacaggcgtgagccactgcgcccggcctatttatttattttcaagacaaagtctccctttgttgcccaggccggagtgcagtggctcgatcttggctcactgcaacctttgcctcctgggttccaagaattcttgcgcctcagcctctcgagtagctgggattacaagtgtgcaccaccatgtctggctaattttttgtatttttagtggagacagcatttcgccatgttggtcaggctggtctcaaactcctggcctcaagtgacccacctgcctcagcctcccaaagtgctgggattacaggcgtgagccaccatcccaggcctagcaccatctccttcggaagatggaactccagtggagctcttactagccaggagcttagagcatgcatgcactttagaaaggaggtgtctatgtttctttcaaaattgttttccctcagacaattttatatcagagtgcttaagattttatgtaaactccatgagtgtaatgtcttttctttttaagaatagtaggaataacaaagatatagaatcaacccaaatgcccatcaatgatagactggataaagaaaatatgctacatatacaccatggtatatatacaccatggaatactacgcagggacatggatgaagctggaagccatcatcctcagcaaactaacatacgaacagaaaaacaagcatcacatgttctcgcttataaatgagagctgaacaatgaaaacacacggacacagggaagggaatgacacacacttggggctgttcctcatctagcacatccagtacaaagtatggaacacattttcaatatacgttttttggttttttggttttatttttatttttctgagatggagtcttgctctgtagcccaggctggagtgcagtggtgtgatctcagctcactgcaacctccgcctcctggattccagtacaaagtacgtaacacattttcaatacatgttttttggttttttgttttcatttttatttttctgagatggagtcttgctctgtcgcccacgctggagtgcagtggtgtgatctcagctcaccgcaacctccgcctcctggattccagtacaaagtatgtaacacattttcaatacatgttttttggttttttggttttatttttatttttctgagatggagtcttgctctgtcgcccaggctggagtgcagtggtgtgatctcagctcactgcaacctccgcctcctggattccagtacaaagtatggaacacattttcaatatatgctttttggttttttgtttttatttttatttttctgagatggagtcttgctctgtcgcccaggctggagtacagtggcatgatctcagctcactgcaacctccacctcctggattcaagcaattctcctgcctcagcctcccgagtagctgggattacaggtgcacaccaccacacctggctaattttttgtatttttagtagagacgaggtttcaccgtgttacccaggatggtctcgatctcctgacctcatgatccacctacctcagcctcccaaagtgccaggattacaggtgtgagccaccacacccagcctaataaatattttttgtaatgaaaacatagataagtaaatgagaagtgagataaaaataaaatgaaatgaggcataaatgcgtatggagtggagagggaaaaaggtcaggtagcagagggccagagatgagaggcttaggaacaccagaattgtatatggatacaactggggttcagccagctcctgggtcaggtgactgtgcagggagctgcttataaaagaggaggcaatagttctgttgcttttcttcatctcagaagaacagtcttgatacttaggtatgtttttggtagaattgttgtgttaataactcttctttaagggaaaagtatctttaaattattgccacattgccacgtgattgtgattaggagttttagcaatttcctaaaaaggtctactttcaaatgaaacatttggagaagtttttgttttcttttgtttctattgaaggaaataaagcgttgactagttattttcaagtttggggaaccataagtgcatatatttcctaaatgacataagagctcatttactgaaagaattaaccaaataaaattaataatccaaagaattgtcacttaatatctataatatcctgatacaactacattgcaaaattcaaaggctattttttacaactactttagtgagattctactttctgaataagttaaattaatgaatataatcttataatttagaaaacaaaacaaaaatgttctcttttcccaagaaatatacctgatttaatattttgcctctattgtacaaaaagtacaagtgtacttttgtaccatctttactcttaagggatatctggaaaaatattttaacaatcccaagagaaggctgattgcaaaaacagaacttatttctgcaaattctaaggtcctctctgtttgaattagaagtcctgcagccagccaaagcaattccttatagtctacattttctgttcacagatttcatttcccacgtttcctgtcttcaaatgaagcaatatagaacggggtaattgaacaggctttaggatcttccagtttgagttcagaccctgtctcattgcttaccgggatatgggaacttggcacctcactggacttcaggaagcctcagctttcctatctggtgtgtggcaaatgtccaaccacgaaggcagcacttcactcagcatccagtacagaggaaggatgtcagcagtgctgtagattgtcattacatgtttgctcaaccaagaatgtttccactgagtgaggctgattgggaaaaaatattatagggcggttcactcaacataacttctcaaatctttctgcttattgaattatattaaaaattcattttcactagtaatttgagtctcaaaatctgaagggctgggtgcagtggctcatgcctgtaatcccagcactttgggaagctgaggcgggcagatcatggggtcaggagtttgagaacagcctggccaatatgataaaaccccgtctctactaaaaatacaaaaactagccaggcgtggtgacgtgcacctgtagtcccagctactcgggaggctgaggcagaagaatcgcttgaacccaggaggcggaggttgcagtgagctgagatcacgccactgcactccagcctgggcgacagagcgatattccatcaaacaaaacaaaacaaaacaaaacaaaatctgagtcttctatgcctctcaaagaaatagcattcaagcttaacatagaaaacaaactcattgagggtgcataagcagacctgtatactcaggtctgaaaaagtcatctttctcttaagatgcttgcactttcttgcctgatttaagttatgttgaataatctcaaataatataagaaaaataactatttaaaaagtagagttatgagcagcggggtacaggagcaggaatcggcttggtgcttaaagaaatatataatctaattccttaactcctgtaaaataaaaccaaaatgtaggtactaagttcagttatatttcggaggctaacattagcctaacgtactgtgctgtaagacctggttcctaccaccacagaacaacgtgcagttagaatccagcctcgttttccctctctctctgccccatgagctccacctgactttttgaaaggccccctccctttgagcagaacttggttcctcattcaatccaattcccatttctttatccttcctcctgagctccgttttcgaaatccgtttttccaccctcccttgtaggtctaatgcctgttcctgtctctctacactgcttccattatggtaacctgcacagtcttaacttgaatttctttcagaaatataataattctgccaccgcatcacttctgtttgtttgccctaatcaaggttaggcatttggggacacctagattcaagggatgctgggaaatacgcataactgaaagacgcccagcaccgtcttgagaggatttgttcttaaaggaaaaggcacacatgtaacctgttagataaagagctgcctccaacaaagcagggaagaagagaagacaccgtgaggccatcttgctgtggcctaggatcggggtccccaggctgggtgtgagtcttccaggcctgaggactcaccttggttctcagggccagcctctgcggaggcacaagtcctgatagatctccttttgcttctggcacggatttctctgcaggccccttgcctgcgtccctggtccctcctttccagtctccttccttgctccctcccatcctatgggaagtcggtatcttagcagatgccacatacttgcctcctaacacatctgtgataccaaatgccaactttctggagcgcctatcttaaaaaaaaaatttcaatttttattaatttgtaggtttttttcatacagtaaagttaacttctcttctgtgtgcagttctatgagctacagaacagctcctgggcaatccctcatactgtccctcatgctctccctgacatcacctcctggtgacattgatgttctccacccctatcggtttgccttttctagaatctcatatgaatgggatcgtccagcgtgtacctttctctgtgcatcaatacagcaggagttggctcctctccctgagtgcacgtcagtttcacttctgctgttgcacctgtcaattgttcgtcctactcatgccactgcggggctccaccatggcttatttattcattcaccagctaaagggcatttgggtttccagtgtttggtaattacaaataaagctattacaaacattcatggatagttttttgtgggaatgtaggttatttcactggggtcaatgcctaggagtaggacttctaggttttttggtacatacgtatttaactttgcagtaaactgccaagttgtttttcaaagtaactgtaccattttgcatgtccaccattagtgtatgacatgcaaaatgctgtggctggagaacctttgcatctacattttctcctctctcaatggtccatcttgccctatcagcctgtctgttaacactacactcacatctctggtttgaaacttcatatctattatttaagttagcaaacattattcaggaccagctatgtgttaggttactcttcctggtgttataattcagtgatgaatttgagatttaaattccataaactttatagattgacattctggtaacacatgcatgcataattaaatggatagacagatctataaatttaaaaataaatttattttagaatctgcagcatccaacatagtagccctcagccacatgtggccattgctccgtgaactgtggccaatatggacgcaatgagctgtaagtgtaaaatgctcacgaactgctgaagacttaatataaaatgacttatgatttttacattgattacatgttgaaatgacaatagtttaggcatacagagttaaataacagtaaaattaattttactgtttcttttttaaaaatataactatgaaaacatttaaaataacatatatggtttgtattttatccatatttctatcgctatgcaccatttttcatagtgaggtgtaataccaaaaactcaaaaaagcatgctattacagagcggctgatgttacagccagataatacttttaatacaagagtcaggaaaagttttccgagaccctggcatgtgcagtccaatctggatgatgggaaagaggcaggcatgtgacggtccgagggaaatgtgtccagctgaagaaacaggacaagcttggtcctgaaagagcaatgaactctgggtgtttgaagagtcaaagaagccagtggggttgaagtggagtggtgaagagaagaccggtgggagggagcgcagagtggtctgcagaattcagagcctcagaaaacgtggtaggaaacatggattggtaccgagccaccactcttcccagggaactcttgcaatgtctcctaatccaacaacactccctttattcattgccgccctcaaatatgaagcatgactaccatttactaagctcctactaagtgccaggtgctgaccacactcggcactctgtggcttgctccagttggaattcaggcttcctttgccattggcagaggttctctcctgttagcatcgtttcttcacttgccctctgggatctgcattctcctggccctgtgtcatccattatctccctgtctagcaagttagggccaggtcaagaaaacctgtatctctcaccttcatagatttttgccttcacctttaccctggttgatatacgagatggatgcactttagatttttaatctaatctattgatgttggagctgtcaaaagacccaagtttcatgtttttagatacacatatttttcccagtagaacctctttgtaatcaagatgcttcttaaaatcagcagctgtcaagagagagttgtgaaactgttgcctttgtcagcacttgagcaagtgtgatcacaggttcattttctcagtacgtgagcaagtgtgatcccaggggttcatttctcagcacgtgagcaagtgtgatcacaggttcatttctcagcatgtgagcaagtgtgatcacgggttcatttctcagcacgtgagcaagtgtgatcccaggggttcatttgtcatgacttcaagtgagttgtgcatgttgcgtgttgtgatccatatgtggagttttgatacttaacatatctgcaaatagattgcactataatttgtctttgaaataagttattgtgtttacagaaagacagggacataaaactataatccataaagcacacagcaattttatattatataaaatataacagttgatattagtaaaaaagacactagccattagagaaataaccataatttgatattttcttataaatcatcaacagagagttttatataagacatctacaagtaaatgaagatatgctgcatttgactactgctatgcaggtaaaactactacctatagtgtgccaaaaaaaatagaactggaggcagggaatattgctcagtcccaagagagcaccctcttgatggcatatactaagcaaaagacacagccaccaagtcacaatgttttcttataaaattcacaatcaatatgaagatttaggcatacatttccagtgtttttggcttatagcattgtttatattccacaaaaataccatatgattttaaaaatccttatctaagtttagaggagctctttcataagtataaaattttaaaactggaagtgattaaaaaaagcatgtataaatgaattagcagcattatctctgctagtagtacagaaataagggtgtacctttcactatacagttgatccttgaacaacacaggtttcaactgcatggttccacttataggcagatttttaaaaataaatgtattggaaatatctttagatatttgtgacaattttcaaaaaacttgaagatgagctatgtatcttagaattatcaaaaaatgtaagaaatgatatgtcatgaatgcctaaaatatatgtagatactagtctattttataatttgccaccataaaatatatatgaatctattattaaaaagttaacacttagagaccatacacgaagccattcacatttgagagaaatgtaaacaaataggaagatgcagcattagattataacttactatattcgttactgaattcgtctgttttcattgctataaggaagtacctgagattgggtaattaactaaaagaggtttattttggctcacaagcgtcagcatctgctcctgatgaggccccaggaagcttccaatcatggtggaaggtgcaggggcagcaggcgtgtcacacagcgagagagggagcaagagagagagtggggaggtgccaggctcccttcaaaataaccagagctcacatgaactcacagagtgagagaataactcatcaacatgagggcagcaccaagccattcacgagatcatccccaccacctcccactgagggctcacctccagtatttgggcatccggaacctctggtgaggcccgcaggaagtttccaatcatggtggaaggtgaagggggagcaggcatgtcacatgcagaaagagggagcaagagagagaaggagaggtgatacaggttgcatgtttgttctctccaaatctcatggtgacatgtgattctcagtatagaaggtgaggcctggagggtggagactagatcacgagagaagatgcctcataaacagtttagttccatcccctcggtggtaagagagttctcgctcagttaattcatgtgatatttggctgtttaaaagggtctggggcctcccccttctccgtgtcactcgttctcttgccatacctcatgcctgcccctgcttcaccttctgccatgattggaagcctcctgaggcctcaccagaagccaagcagaagccagcatcatgcttcctgtacagcctgcagaaccatgagccaattcaacctcttttctttataaattacccagcctcaggtatttctttatagcaacacaagaacagcctaacacaggaggcgctaggctcctttttaaaacaaccagattacacatgaactcagagagagagaaattccctatttacggtgaggacagcaccaagccaggcatgagggatctgtccccgtcacccaaacacctcccacgaggcccgcctccaacatcggaggtcacatttcaacatgagatttggaaggggcaagccattcaaaccatatcagatacctactgtactgctgcaataatattattgtcgtctcccattgctactataatgagctcaaatatccacctacaacactgcgtgatgctaatcatctctgcttgaggaatttgtctttccagtaaattctgtggtgtagtgaaaagtgatttctcaaggttcttgtgtatttttcatcatgtttagtgcaatatcataaaccttgaataacaccatgtggcccttatgaagtgccacttgtaacgctggaagtggtcccaagaagcagagaaaactcatgacattacaataaaaagttgaattgcttgatatgcaccatcaattgcgctctgcagctgcggcgacaccattttaagatgaatgaatctggtgttagggctcctgtaaataaagaaaaggaaatttgtgaagctgtcactgcagctaaccaggaggtgtgaaaatcttgcacaaaaggtattttgtaaaatacctttttaatctcactttgaaatatagcatttatgagggtgcagaatggctatacaaaaggcatgtctatagattctaatatgatttgagaaaaagcaaagtcattgtgtgacaacttaaagcaaaaagaaggtgaaggatctaaaactggagattttaacgctagcaaaggatggtttgataattctagaaaaaaaggttggctttcaaaaatgtccagataacaagagaagcagtttctgccaaccaagagccagcagataagttcccagatgccattaagaaaatcattgaggagaaaggacatctgcctgaacaggcttttaatgcagacgaaagtgccctattctgggagagaatgccgcaaaggaaatttattagtaaggacgagatgagtgctgctgagccagtgccagacgatgaggaaggagatgtaggaaaagcagtcctggaaaacaaattggcatcagacagtctggcagagggttctgatgattcgaaagagcttttgtcttctttcactctatgggcactcctatgggctctgaaactacaaaaatcagtggaagaaggattgatacaataaagacacttttttagagaaatgaagaagaaaagagtcaggcagaaattacaacatagctccataaagttacatggagtgtgcctgcctctcctgtctcccctcccacctcctccacttcttccacctctgccaccccgagacagaaagaccagcccctccccgtcctcctcctccccctcagcctactcaatgtgaaggtgaggatgaaggtgattatgatgatccacttccacttaataaatattaaatgtattttctcttccttatgattaataatattttctttctctagcttacttcattgtaagaatacagtataacatacataaaacataaaaaatacggttaatcgactgttcatgttattggtaaggcttcctagcaacagcaggctaacagtagttaagttttggggagtcaaaagttatacatggatttttgactacatgggcgttggcacccttcaccctcacgttgttcaagtattagactccttgatgccaagatgtcaaatgagtctagagccatatggaaattttctatgatcaagagtgaacacttgtgtctctcaccttaaacattctctggccagcaggccagtaaggcagtggaaagatcaaaaggaggatttcccattggcacccgctcaccttacgctctcatcctaaggtcaaaaatcatccagtgattttcaacagcagtaatcatgccctcatgcccaggagccacggaaacaggggaaggaaggaagttggggtcacaaggacttgggcagcagaagatatttgttgataaagctgataaatgttttgaaatcccaaggacagttctgcataatgaagaattgtcccagccaaaatgtgagtaatgtcctgttgagaaacctggatattatgtgtggcttgagcttactttatagatgcagtcctcttacttatcaggaaatgctcaagatgcctgtgctaggcctgacctagctgagctgttgacttgaatgtgcagaaggaagtcctaatggtacatgagcacctctcacaccattcagagatttcctcagattggatcactctgtctagtttctgtcatttctaaatacttcaaaaagttacaagtaccaaaggcaggggagcatcggcagagatggggtcacagtgggtattctttataaaaattttgtctaatctgtaccacagacttggaagaaaggctttgttggacattaaggtgagcagggctcatgcccatacaggtggctagctaaggaaaacgatgcttcacagtgtcctgcctgtgagtcagcagggctggactctacacagcaatgtacactcggatccctgactttgttagcacattgaaaataatttagtctctcaggagtggatcacacaaatcatgatcactgacactcattgcacttcactttcagattgtccttgccaacagagaactgcattcccttcatggaggcaacctaagtgtaaagtcaccttattagaattaacttgacatccttcaccccactttgaacattcaaagatcaatataatttcgtaggataatcccactcctaggaatgcatttctctttattttgcctcatgaaaatcccatgcaatacttccttcaaagcaaaatgcaaaggctattcttttgaagctcattttattacttgatttgcttcaccctgaacacctaatgctcgtcaatagttccattcctgtgtcacttagcatggactatattccattctagtcatttaagaatatctcattttctctactcaattgtaatctttttgaaggcaacagccataatcataaattaatttttacaaagaacctagggtagcaggtatcaaaaaatggctatcaaattatgagaatctttgccttagaagatgaaaaatacttgggagatgaaataataagtttgagtcaaattaggtggactattaaatggtaacattaaaagtgaagtctgacttggactctcagtcttaactctagattagtggttctccaccagggctgttttgcttctcaggggacatttggtaatgtctggagatattttcgtttgtggtagagagatcaagagtacttctaaatagcttataatgcagaggacagcccattacacacacacacacacacacacacacacacacacacacacacacatacacacacttctgacccaaaatgttaatagcatcaagatggaaaatatctgttctagatctaccaaattaatttcttttttcttgttttcatgggctagctaagtttaaggacctatggagtccactgaggatattctttttaggtaatctcaatgttgcagaaagcgtcattattatctttaccatcattatcatcataaccatcgtcagcttcaacagcagcaacacttcatcaaaattaaatattgtgatagtttgagaaattttagggaaactagagcataatcttcacaattctgaaactcagggatgaaaactgtgtgtgcagtaatcttagaactattgaatactagattagggggaaactgagagggcagctgtcattatttctgtcatttcaaacattggcatcactagtacatctagcaccttccattcaaagatgagattagaggaaaaactattttagagtcaaagatttttccttgtaggtacatattttgtagagaacaaagttctctatctttcctgtatcatgatctatgcatcttaaaaagtgtcaagaaatttctttctatttaattcagtttttttctggttggatcccaaagcattttttttttggtttgctcctctatgaagcttttctctgcctattctgtataacaactgtttacaggtttagaaatgcatgagcaaatgtttttgcaaccttctcttcctgaggaaaaataatcaagtgaccttatcacagcctcctggtatccatccttattttgtccctgtcagtttattcatctgtcccctctcttaatttcttggttcctttaacctatgtatctgtagtctgcaacacacacagatacacacacacacacacacacacacacacacacatccctctacaggacagttatacaaaaatgcaaaatgaaagaagtggagaatagagtatttacgcaatgaaaaaaagctgaatcctagaataatgaataaagagaattgtgggttcagattttcaaagtatacttagcttagtgacagtgaatggaaacaactgctatgttgaatgacagaatgattcaatgaacttgagttctttcactctgggccgcctcaatttctgcctctgtttctgtctcttgagcaagaatggtgtaggtttcataataagcatggattactgaatagatgtcaggaagagaatatttgtcctctaaatcaagtattcaattgactttctatagatctggcatgaactatgatgtagtccaagaattaaaaacttttaaagtagttgtagaaaatggtttctcagtcgtccagtttttcaggtttgccagtcccaagtgtattagcaaaattctgtaaatgcgaattatagagttaaaaacactagaagaggaggaaaaaataggtagtggtggatgaaaattttgtgcaattgataagaaaaatttttatctaggctctccaggaaccagctaactgacttgggctgctcactagccctgtctgggtcttaatgtctttgtccttaaaagggaatatatggtgttcatctgctgccagtagtatcatatgtcattaatcttttgggttcccatatggctctagatatgatgcattttgatgtcctataaaatgggacatgttaaaagttatatatgaaagcacaaattactaacatcaacaacgaaagagggaccattactacaaaccccatggacactaaaaggatagtaaagggatattgtaaaaaattctatgcccacaaatttgataacttagatgaaatggaccaattctttgaaaaatacaatctaccaaaactcacacaagaagaaataaacaagctgaataagttcagaaattgaattaaattacaaaagaaattgaatcaataattaatcatctaaaacagaaaacaccaggtccagatggatttactggacaattctgctaaacatttaagaaataaattttaccaattctctacaatctcttctagatgccaaaagcagatggaatactttctcgcttactctataaaggcagcattactctaataccataccagacagacctttggaaatgtaagaaaagaaaatgtaagaaagtgccaatatctgtcatgagcacagctgctaaggtcctcagtaaaatactagaaaatttcatccagcaatgtataaaaagaatcatacaccacagaaaatggatttatcccaggtactcaaggcttgcttaacatttgcaaaccaatcagtgtattccatcacaatcaacaggccaaagaaataaaaatcacatgaacatatcaatagatacagaaaacacatttgacaaggtccaacacaaatttataatgaaaatctctcagtaaactagaatagataaagaatttcttcaactttataaagaatatctacaaaaaaaaactacagctaacaacacttaatggtgagaaacccaaagcttttccgaaaatattgaaaataaggaaacaaggcaaggatgtatgctcttactactgcttttcaatattttactagaagtctttgctcatgtaataaggcaaaaaaaaagaaaaaaagaaaaaaagaaaatgtgtacagattgggaaagaagaaataaaactgcctttgcagataatatgattgtctatgtagaaaatccaaaaaaaatggacaaaaaaaattcctggaactaataagcaattacaacaatattgcagaatacatggttaatatgcaaaagtcaatgaacaagtggaatataaactttaaaacaataacatttacattagcatcctcaagaaagaaatacttaggcgtaagtctaacaatttatatacaagatcaatatgaggaaaactacaaaactttgataaatgaagttaaagaataaataaatacatacatcaataaataattagggaaatattccattttcataaatagccccaatattgtcaagatgccagcttatctcaacttgacctatagatttaatataatcccaatctaaatcccaagtagtttggatatatctataaactgattctaaaggttatatggagagagaaaagagccagaatagttaacagattattgaaggagaagaacaaggttggacaggcactagtcgactacaacctactataaatctgcagtaatcaatacagtgtgatattggtgaaggagtagtcaactagatcagtggaacagaacagagagaccagaaataggttcacataaatatagtcaagtaatctttgacaaaggaaacaggcaatacgatgaagaaaatatagtcttttcaataaatggtgctggaacaactgatcatccatgtgcaaacaaataaataaataaatcatgacacaggccatacacacttcacaaaaattaactcagtgtggattatagacatgaatgtaaactgcaaaattataaaactcctacatataacatagaaaacaatctagatgatcctgggtttggtaatgactttttaggtgtaacactaagggtgcaatacatgaaaaaaagaattgatgaagtgtccctttgagaaagatgttgttttttagtgtgcttcagccatttgaaaatagcaagatagtgcatacagatcaactctgtgagctttagttaaagaagaaaaatgagaatccactggaataatgaaagacacttcagatcccagggagaagaacgttggcaaacagcccccttgatgttgtccagctgataaaaatgagtgaaaccccagtatatgagagaggtagagagcctccccctggctcacctttccactggggagctgagcaacccaggccaagggaggccacattatttctctgaagccctggagctaacttgaggagaggcttagagatgctgtgagggaaagacactgaggaaagcttcagacattttcccaaacccaggactgagaacaagataccatttttaatccaggagcatacatggtcagctattcttaggtgatctggcagcatggtcatgcaggcatttaagtttccggccagatactggaacatttgctctggagtagggtagggacttccacaaccagaactgtggaaagtttgtcagcagtaggcactggaattatgctttctctcgtctcaaccttggggtaggaaaagagctgccacagctgcaatatctcttgggcagcaagacttacagccagggccagcttggtgaccagaaactggtctctgtgtgtgtcatttctggatgccccagactgctctcctgagatcatggtgtagtgaagccctcactgctccatgcccaggcagattgccaggcattcggagcacccactcacctggttcagcaacctgagccccccacccatagtgtgcacctttcctctgctacatgcccaaacacatctccaggtatctggagcatccacttttctggattaggagtttaagctgactctcacccctgtgcagagaacttgaggccaaggagttttatcagctccacacctaggcacacctctgggtacttggtggccgcccactggattctccctcagtgttggtgcttttgtgtgccgtttgggaatgtgcaggtagggcctgcctggtctggcaccacccatctggccactagcccccagggatgagcagggagctcaaaccactgtgcattccatgaatcagttcattgtctgaggtgccagagagcttctgcaagtaaaaaaggatcaagtatatgcccagcctcattggccacagcctgctcttacctacgagtaccatctactggcttgtaggttgagctacacggtgcaacataaaacctaattaaagaactgcacggggctagagaagcaaaagccaaaagcattctttagcatcatacctctaggaaggctgggaaaaagaaagagaataaaataataaattattgttatatagaaaaaaataaaaagtaaaaattctacccacacaaaaataattacaaaaaattgtaagtgccggtgtcttcaaataagaagaaggagaacaaaaattgtgacgccataaaaaatctgaatgtagtgataccaccaaaggattgcattagctcttcagcaatgctccctaactaaaatagaaactcagaaatgacagaaaaagaattcaaagcatggattgcaaaggatctcaacaagatccaagacaaggttgaaaattaacacaaagaaacttcttaaacaatccaggaaataaaaaagataaatatctttaaaaaaaaaacagagctgctggaattgaaaaaaaaatcacttaaatttcaaaatataattgaaagctttatcaataagttggaccaagcagcagaaaaaagttcagagcttaagaccagtctttctaactaacccagtcagacaaaaataaagaaaaagtaatttttaataaagtctttgagaaatatgggattatgtaatgcaacaaaacctatgaattattggcatgtctgagagggaaggagaaaaagcaaataacctggaaaacatatttgagggaataatccaagaaaatacctctaatcttgctagagaggtcgatatcctgatatgagaaatccaaggaacacctgcaagatactacatgaaacaaacatcaccaaggcatatagtcaccagactatccaaagtcaatgcaaaagaaaaaatcttaaagacagttacagaaaaaactctgatcacatacaaagacaatgtcttaaggctaagaggggacttcttagcggaaaccttacaagtcaggagagattacaggcctattttcagcatccttgaagaaaataaattccaaccaagaatttcatatgctgccaaaccaagctttacaagcaaaggaagaataaaatactttccagacaagcaagcactaagggaatttgttaccactggaccagccttacaagagattcttaagggagttctaaacatgggaacaaaataataatacttgctaccacaaaacacacagcacatagctcacagaccctataagtcaaccacacaatataaactacaaagcaaccaattaacaacttcacaataaaatcaaaacttcacatatcactcttaacctcaaatatggatggcctaaatgccctacctaaaaagcacagagcagcaagttggattttaaataagacccataagccttctgttttcaacagacccacatcacatgtaatgacaccaatagtttcaaagtaaagggctgaagaaagaccaaataagcaaatggaaaacaaacaaacaaaaaagatcagggagcgctattcttatatcagataaaacagactttaaaccaacaacagtaaaatagggaaaacaagggcattacatcatgataaaggattcaattcaacaagaggagtttaacaatcctgcccccagtattgcagcacccagaattatgaaacaggtacttctagacacataaaaggacttagaaagccacacaattgtagtaggggacctcaacaccccactgtcagcattagacatatcatcaaggcagaaaactaacaaagaaattctgaacttaaactaaacacttgatcaattggacctaataaacatctacagaagattctactcaccaatcacagaatatatgatacattcttttcacttgcacatgaaacatacccttttttcaccactgagtatgatgttagctattggcttgtcatataaggcctttattatgttgagatacattccatctatacttaatttgttaagagtttttattataaaaggatgttgagttttgtcaaatgtcttgtctgcatccattgagataatcatatgatttttatcctccatctgtttatatgttgtatctacctttttgatttgcatattttgaatcatacttgcatcccagggaaaaattacacttgatcatggtgtatgatccttttaacacactattaaatttgttttgctagtattttgttaaggatttttcacccacatttatcagagatattggcttgtaatttttttttcttgtagtatcctcttctggctttggtgtcagaccaatgctcattgtaaaatgggtttgaaattattttttactcttcaattttttaaaaagagtttgagaagaattgttattaattttacttaagtgtttgatagagttaccagcaaagccattggatcctgagatttttgtgtcattttggggagtttttctattactgattcaatctccttacctgttattgggctatttaggttttctatttctatgtgtttatccttttctttacagtcatcaattttttggtgtataaatgctcatagaggccagttttgattctttgtatttatctggaatcaatcgtaaagtctcctctttcattttgaatcaaaattcacaaatatgtaaaaattaaacaataaactttggaacaaccactaggtcaaagaagaagtaaaagaaaattaggaaatatattaagacaaaccaaaataaaaaccgcataccccaaacttatgggatgtggcaaaaggcatacaaagcagggcattcatagcattaaacatctacattaaaaaaaaaaaaagatccccaaaaaactctaaatttccaccttaaggaactagaaagacaagaataatttaatccgaaatttagccaaaggaaggaaataacaaaggctagatgagccaaatatatagaaaaattttttaaatagaaaaaaagtaataaaatgaagcattgtttttgaaaagataaagaatatttaaaaactcttagttaaactaagaaaaaagtgagagagatctaaaataaataaagccagaaatagagaagaaggcaatatatcagctgttgatgataaaaaaattataagggactattatgaataattgtacacaaataaattagatatcagaataaatggataacttgaaagacacaacgtgctaagactgaatcacgaaaaattggaaactctgaatatatcaataacaaataaggagacttaatgaataataaaaaatcttacatcaaagaaaggcctaggaccaattagcttcactggtgaattctaccaaacacttaataatgaacacctgtacttctcaaatgaaatacttccaaactgactttatgaggccagcatcaccccaataccaaagctacacaaagctaccacaaggaaagagaactataggccaatatctttgatgaacttaggtgccaaatcctcaataaaatactagcaatttgaattcatcagtatattaaaaggatcatacaccctgacaaagtgtgaattctccctgagattcagggatggttcaacagatgcaaatcaatcaacatttacaccacattaacagaataaaagataaaatttgcatgatcatcttcaaagatacagaaaatgacatctgacaaaattcaagagtatttcctgataaaaagtctcaacataataaaagtcatgtatgataagctcacagttaacattcttggtgatagcaaattgaaacttttttctctaagatcaggaacaaggcaaggaggtccaccgtcatcactactattcaacatagtactggaagtcctagccagagcaataagataaaaagaaatgaaggccattcaaactggaaagcaaaaagtcaaattaacgctttttcttcagaagacataactatatgatctacagatatatgtgaaaaatcctaacaatcccacgaaagtgttaaaactaagaagtgaatttctcaccgactcaaggggactaagcacaatttctgaacaaatataagttatttaaaagcaacgctgaatatgtagaaagagatggaaattatatcaaacaaccaaatggaaatttctgaagtgaaaagtataattatcaaaatgaaacatttcacagagaggataataaaaagatttgaactggcagaagaaagaataagcaaatttaaggcagattattaagaaagatagaatctgaagaagagaaagaaagaaaagaaaaattaaaggtgcctctgggaaatacgtgacccactctgaaccagttgttaaatctttccttccttttaaagcaattgacaacaaacagctcggactattcctgctattcaagtgtcatttattttctccaggactcccatattagggatgttagacttcttatactgttcagacacctcatccctaagttttaagtttgtcttctgtgtgcttcagtgtaggaatcttgcccttgacctattttccagttaagcaattctgtaatctgaactgtccaatctactgttaaatgcatctactgaattcttaaatcatatttagttctgaaatatccgtttgaaaatttccagcttacgcaggatattttacattgtttgatatactgtgtgcatttttccttctaatttaaagcatggtaattatagtcattttaaaaatattctcccctatgtatgtgctcccctgtctggatcatcttgacactacttagagtgtctccttctgcttctttcttttccttttttcattctctgataagaggtcatacttgttttactcataacctacatagaaatgagttactttgtcaggtaactgattacaaagcaagcacagatgctccgggtacctccattgaagatgttcccctcttttttctgttagactggggagccaattaattccctgagtcagtcatgaattgagctaggtctgaagtaagtgagttttccatgtatcttggactaattctctctctctcatgttgctgaggtctgggcctgctagactttcacttgggtatctgtgtggctctatttcctcagctctgaaacaatataaggattcatctctattacacaaaggttcacagcccagctctccagtctcttgctacaagcaagccccaaattaggtaagtgtcttaacagacagacaatccctgtttaactatgcttcgtgtccaaaatatcacatcagtttaggaaactgtatcctttgataacattgaggctagcttatcaacatcccacaaagccttaacattcatcatatgtgacctggggagaaatgattcagaattgaaggctccagaacatctgatctgtgaatctagtcctgagtagcaatgaagagggttggtggtttccctttctctcagcacacggtctctaactaggtcaaacgtaatcctcaattcacatccagcatctgtaagtgctcccaaaaaaatgaatgactgcaatattcaactcatttcagaactgttttccatgcctaaagttttagttcattaagtacttcttgcttgcacaacttctgatgcccttaaaatatggtttttggccgggcgcggtggctcacgcctgtaatcccagcacgttgggaggccgaggccggcggatcacgaggtcaggagatcgagaccatcccggctaaaacggtgaaaccccatctctactaaaaatacaaaaaattagccgggcgtggtggcgggcgcctgtagtcccagctactcgggaggctgaggcaggagaatggcgtgaacccgggaggcggagcttgccgtgagccgagatcgcgcccctgcagtccagcctgggcgacagagcgagactccgtctcaagaaaaaaaaaaaaaaatatggtttttgaagtttaattgggatttctggtgttttcccagagaaaacatggctttctaagacttattctatcctacatagaattcgttcttctttatcctattttattaccaaaattacagaggggttgattggcaagtgctattctctttatcagattttgaaaacagtgtttctaagtttcagtcttttccccaagatgggaaaaggcaatgaggagaaaattccaacgcttccgatgtctgcttccttcccgtgttttccaccgtagcaaggtaaggactgcgtcacttagacttcaatcacaaaatgagaaaccacaccctgggctaaccatgagtcactaacaggaagatgtagcgatcactactaggactggagatcaaagggaaaggagtggggttaatggaacccgcaagcttggaatagatcccctggttccaggacttcaacctcttaggagagggtagagccaacctaccgctgaaacctctggaattcgtagaggatccaaagaccctctgaggcgactaagacctctgaaggtaagatggatgtttgatggctgtgctggtatccctggggctgacaatgctattggacctgggagttatggaatatatgtaggcaaaacgtgcaggcacaaagctactgctgctgccaaggcggaagctgtgtgttactcaggtaacattgacataaacagctatcagacacttctgtcaggtttccggtctctctagttcccccaacggcaaatactaacagagaggatgggcaaagaggaaatggagtgtgtaggttcccgttctccctgtgacaaagcgcaaggataaagagtaaaaaggggaaggaggcttggaattgaaagacagcgaattaaaacacacagaacccattcgtgagctgtgtctttgctcaagaaacccaagtctaattttataacaaataaaacactaaaattgctttaaaataatgaaaaagcaggaataagctggcattaccttattcaatagccaacatttatgattctaaactataaaagaccttggggatttctgtcagtggtctcaggcatatgcaataaaatttctcctgacagcacacacaaaattaatacgtgagaaatttcatgaatgattaagcttcttttctgaagttttaatttgttttcaagttttttgtaggtgaagtttgaacattttgcttttctttcttaggtgacatttgaacatgttgctttactttttcaggtaaagtttgagcatttggctcttctttgtttttctgtgcgtgatcaacaacaacataaacagaaagcaaagcaaaagcaaaaagggaatccataaatatggtgttacaccccttgcttgcacacctcattttctccctttttcctgggggtggtggtgccactatcaacactaccctcagtgccttctctcaggcagtcaggaggcttccactctcggcagcaatggcagtgatgtttattgttgcagacaggtctcatattacaggtcacgggcaaacaggtactgttcaaaagtgacatagtgacacatttcctgtgcatacagacgtgttctgaaccacactcggtagcatctttcacgtcaccaatatcaggagtgcttatccccattcgatagccggtatcccagcaggtgacaccaatgaagtgagtccggtgcagagtagaatgatctctcaaaagggggatttcttgcatgttctcacactcaactctcccacacaagatatctgtgacctcacatcttacctatttggtgccattgaaaccacagtgaccaaaatgatcacctcggatgttcatattactgcagcaactctgatttgcactgttggctacctggccaaaaatttgtctacactgttcatcacagttattacatctcttttcgtagcagtggccactgcccttgcaggggatcccgtcctgcaaacacacatcttctgcacactcatgcgaagtcccgttgaaccactctggaagatcccattcgctggactcttgtctgcacacttcgaccgatggcatgatctggcagtttttgcagcaaagccccaaaacacaagcagccccaggtttgaaagtgcaatttgcaaagcaacatggctcttttcacacgatggtaagtttccgcggtcatactcttcttctaccgcaccattcccacagcacctctgtgtcatgattctatctcgatttggtgaagcatgcatgcagatcgttgttacagtggtttgaaaaaatctagcattaactacagttgctgaatctttttgtggaagttgccgttggaaacattatacacttttttgcccacaggaacatgtttttgtatcatgagtcatacccaaattatgaccaagctcaggtgctgctacgagtgcaaaagatcccactctgttatgtccaaaactgttaattgcataattactttctctataacatactgttccaacattggctaagccaagagtaataccataggagcgttttacaataagatgtgcaacatcatgaggaatgcaagaattaaagctagtttgtttccatttgcaaatttctttcaggccaacacctgcagtgtccattgtaatgaagttttcttgagtccagatctcaagtcccactacagtgacaattggcacccagtggaatataaaatgcatcagctttttgatacagcatgagtacttcctcctgcacatttgaggtatgactttccagataaaggaatcattcatcatctaccactactgccagttcaacaaacaatttatgggtccaccagccctcaaagccactttgcattagagtagaaggatcttgaaacttcaattgtcttgctatttcttcctctatcaacccacatctcatgggtgggaattgtgtctcctcattgtccatcttatatatcagatgttcaaatgtggctgaaacccttttgggcttgatttcctaagcagtgtcatttatctgtggtattccttgaaagccccccaaacagctgctaagagcaaccagggattctgggtccccttccacataactgtgatagtagcagtcatcctggacaaaagttggtcctcaaaaatagcaccctggtctgagtaggtgaacacagagaaggatttggatatcaaaaatatcaaaagcttattgaccttcatgtggacaatgtacctttggctgccaacttgcaggccataggacagccagccttgagtgtccgtgcctctgtcagcaccagttatcctcaggggtatcaccacttctgggaggctttggtgttgacagagcccaatctggagccatccagaaaagaacagaaacactcccagccagagcagcagatggatgaacctcacatggaccagggcctcgctcactgccctcatggagccactgtgatggagctatgggtgagagcaaaggaggggaggcaggaggcacagctggtctgtctcctcctctgagttgcttttgtttgatgttgagcttaatggtctttctgctggcagagtcagtctatcagagcagcacagctaaaagataaagtgaaaagaatggcagagatggggtggtgtgagcagaacagagtggaaaagagagagctgggtgtgggtaaaatggagtcatatttggctcaggacgtaactcattatactgcattggatttgcttctgcatattggcaaggcagagtgagactgtgggtgtaaaaaagaatgacagttggctgcaggttgataattactgaacctagatgaaggacacatgggttcattacactgttgtctaaatacacgtatgtgtgtgaacatttctgcaacaaatacctaaaacagaagagtcttaatggaaaggggaacgtatatctcattttgatgagagaaccttgatttatgcatatagacttggaataagtgtagatatttcttatcaatttcaaatgataaattattcagtcaccttactcagaagagagacataaaaatattcacacatcttactttcttatcatggtcctcaatatatacttctctgcaaaatattacttgtcctatcttcatctaatactgtcaaactgcgtagtgtcaaaatatcaattatccttcaaaaacgttagcgtctattttaatggatcccaaattcaatataataataaaccattgtggaattaaaagaggatataccttgggttgacagacgttcccgaaagatgatcatatttgcttatactcttatgaaaagtaacatttgtcaaagcctctaacaaaataaaatggaaaggaaatcaaactagctggaaaagcaacagttggaagtgggaagacatggaagggaaagcaaagtaccttcagaaataaatagaaaatcaatgagctccaaaaccaggaaggaaagctttggaggaaggtaggatttttgtccttgagcaaagatatcaaaatccatggcatttttagggttataaggtgaccactcctgagatccacccttgaaggtatttatgggataaataaaaatacctattccatcaaaaaaataaaatacaaaaaaggtctcaataatacaaatgtatcatcagatatttatgaaaatgagagatctggtactagcacggtgcctggctgccaatactgatttattgctgttcttgaataaaatattaataaaaccacctgatatacagacattatgctgcaaattttagaatataaatgaatgatactggcctaaataatttagtagtctggagcaaacatttagggagaatgtttggggcaaaaacacactttaggaatctgcataattacattcaatattttacatgtaaaatgcctaatgttgtttagctagtgagagtaaccacagtctttatcagacaagtaaagtaatgagattaagaattattagtcaagttgagaaaaaaaaagacctgaggaaattgaaatctgctttgagtgacctaaaacagagtgatcaaattccacttttcatagtaggtattataaaaacaaaagacgccagattcagcacctaacatctcttggacttggacccatttttctttaaaatttccttaatttttcttttatcttgattctaagtgtttgatctctctgcaatcattttcttgtcactcatggaatcttcctttcatgaaaagcaacaagaatcttttctctattcacaaggttttatggtgagcttcttattcatactaggttttacaaaaatgtatatctcaacaatgtgaatcccagcagaaaggaggctttgtcatatgccctgcagaacatatgtagagatatggttttgccatgttggccaggctggtctcaaactcctgagctgaagtgttctgcccaccccagcctcccagagtactgggattacaggaatgagccactgagcctggcccaataatagttttgagtaaaaatattgcattaatgtttaagctatagttatctagaaaatattaagttttatattgcttataattagtaagtttcccattaatccttttgcttcttactttaccatctagaaaccaaggctactaatactatgaggaacttgttgggaattggagaaaaggtgactttcattatgctttagcaaagagactggcagcattttgccttttctcttcagatctatggaacattgaacttgagagaaatgatttagagtatctggtggaagaaatttctaagcagcaaagcattcaagatatgatgtgggtgctgttaaagacattcggttttatgtattcacaaagatatggtttggaattggaacttatgtttaaaagagaagcagagcatgaaagtttgaaaaatttgcagtctgacaatgcaatagaaaagaaaaactcattttctgaggagaaattcaagctggctgtagaaatttgcataagtaatgaggacccaaatgttaattgccaagacaatggggaaaatgtctccaggacatgtcagaggtcttcatggcagcccctcccatcacaggcctagaggcctaggagggaaaaatggtttcatgggccaagcccagggccttgctgctttgtgcagtctcgggacatggcaccctgtatcccagccatggctaaaagggcccaatgtacagctcaagccattgcttcagagggttcaagctccaagccttggcagcttatatgtgtgttgggcatgcaggtgtacagaagtcaagaattaagatttggaaacctctgcctagatttcagaggatgcatggaaatgcctggatgtccaagcagagttgtgcttcaggggaggagccctcatgaagaacctctgatagggaaatgcagaagggaaatgtggggtcagagcccccacacagagtccccaggagggcactgcctagtagagctgtgaaaagagggccaccatcctccagaccacagaatgatagatccactgacagcttgcaccatgtgcctggaaaagctgcagacactcaataccagcctgtgaaagcagctgggtgggggtggggatgggggtgctgtaccctacaaacccacaggggcagagctgcccaagaccataggaactgacctctagcatcaatgtgacctggatgtgagacataaagtaaaaggagatcattttatgtcttgactgtcctgacagatttcggacttgcatggggcctacagcccccttcattttggccagtttctcccatttggaatgagtgtatttaccctgtgcctgtacccccattgtatctaggaagtaactagctctttcttactagacataaaattaactgagacagttttaatttcattttgatttttttctttagcaaagggaaggttcaaggcccccccaaatcagtatcaagcagaagcattttttcaacaaaacgcttttcataatcagatacaatccacattgattccctcagagatatactacagaggttctctttcttgaaatgtttatatgttaaagtagaactggagactcccttgtctctggatgggtaaacaaaaagaagatgaccacgggcaaagttactgagcacaggttacttactgttatgtaacaaattaatctagtggcttaaaaattcattttataatttattattatttattatattatttatgtgtagggcaggaattcaggcagggtatggctggacaattttcgctccacgtgatgtcaatcagtgttcatctggtggcagacagctggtggtttgactggtcttgagggtctgaggtacatttactcattgtctattccttgacagagatggcccagaaggctgagcttggtacagtctgttccttagagagcctacataatacctctgctgcatgaatttcttcttacactacagtgctccaagaacaatcattccaggaggtacaggcagaaactaacaaggcttcttaggatttagcttcagaagtctcagtacataacttgccacattacattagtcaagcaaaaagtaaggctaggtgagattcaagtgaatttggaaggttttaaaaggaggaagagattccatttcacatttaaaaaaatggcatgtgtcttcagcaaaggaatatatagctgaaacacatcacaggcacaaggtacttcagtttatactctagctccacaatttaatttgggtgattatttttaatagactattttttagagcaattttaggttccaagcaaaactgagtggaaggtacagagatatctcaaatggctcctacccctatgtaagcatggcttccctcattattatcaaccctctccaaagtggtacatttgttacaactgatgaacttatattgacacatcattgtcacctgaaatccatagttaacattaggttttacttttagtgttatactctctatgggtttgacaaatggataatgacatgtattccacatagtatcatacagagcactttcactgccctcataatcttggcacttagacttttcatccctcctttcccctaagccctaagaaaaaccatatcttttaacactcttcatagttttgccattttcagatgtcatattgttgcaataacatggtatgtagtcttttcaaattgggtttcttcacttagcaataggcgtttaagtttcctccatgtcttttcatggctcgctagtgcatttctttaagtgctgaataatattttattgcctggctatatcccaacttatttatccattcatgtacttaagggcattttggttgcttccaagttttgacaattatgaagaaaatgatataaacatccacatgcaggttttgtttgaacataagttttaaattcttttgtgtaaattcctaaggactgcaattgttgaccatatggaggggtgtgtttattttatttatttatttatttatttgagatggcgtcttgctgtcacccagactggagtgcagtggtgcgatctcagctcactgcaagctctgcctcccgggttcacgccattttcctgcctcagcctcctcagtagctgggaccacaggcacctgccaccactcgcggctaatttttttgtttttagtagagacggggtttcagtgtgttagccaggatggtctcaatctcctgacctcatgatccacccgcctcgtcctcccaaagtgctgggattacaggcgtgagccactgcgcctggccggggtgtgtttatttttaagaatacaaggtatattacaaagtagctgaactattatgaattcccacaagcaatgaatgagagttcttgtggctcatcatcctcgccagcatttgatgtcattagtattttggattttggctcttccaatgtgtgtatagtggtattttgttgttttaatttgtacggtcctgatgatggattatgtggagcatcttttcatatgcttatttgccatctgcataacttcttcagatgtctgttagtctttgatccaattttttaaatcagttgtttccttactgctcatttttaagagctctttctctattttgaataattatttatcagaaaagtattttaaaaatgtttttctcccagtctgtatctttacttttcattcccttgacagtgtcttttttctttctttctttcttttatttttcaacttttattttagattcaggggatacatgtgtaggtttgttatatgggtatattgcatgatgctgaggtttggagtataaatgatcccatcacccaggtagtgagcacagtaccaaatagatttttaacccatgcccttttctcccttccctctccaatagtcctcagtttctgctgttgccatctttatgtccatgagtacctaatgtttagctctcacttatgagtatgaacatatggtattggtgttctgtttctgtgctaattcacttagggtaatggcctacagctgcatccatgttgctgcacgtagacatgtttctattctttcttatggctgtgtagtattccatggtgtatatgtaccacatttgctttatcccatctgtcaccgatgggctcctaggttgattccatgtctttgctattgtgaatcgtgctgtgatgaacaggcaagtgcatgtgtctttttggtgaaatgatttgttttcttttggatgtatatctagtaatgggactactgagtcaaatggtagttctgttttaagttctttgaaaaatcttcaaactgctttccacagtggctgaactcatttgcattcccaccaacagcgtataagtgttcccttttctctgcagcctcaccagcatctgttgttttctttgactttttaataatagccattctgactggtgtgaaatggtatctcattgtggtttggatttgcatatttctgacaattagtaatgttcagcattttttcatatgtttgttgccttaccgtgtgtctttagaagtgtctgtttatgtcctttgcccactttttaatggggttgttttttgcttgttgatgtaagtttcctatagattctggatattagacctttgttggatacatagtttgtgaacattttctcccattttgtagggtgtctgtttactctgatgatttattttgctgcacagaagctctttagtttaattaggtcccacctgtcaatttttgtttttattgtgattgcttttggagtcttagccataaattatttgccaaggccggtgtctagagtggtaattcctaggtttccttctaggattcttatagttttgagttttgcatttaaatctttaattcatcttgggttaatttttctatatggtaaaatggagtgatccagttttaatcttctgcatatggctagtcacctatctcagtgttatttattgaatagggagtcctttccccattgcttatttttgttgacttttgttgaagaccagatggctgtaggtgtgcagctttatttctgagttctctattctggtccattggtctatgcatctatttatgtaccagtaccatgctgttttggctactacagccttatagtacagtttgaggtcagttaatgtgatgcttctggctttgttctttttgcttaggattgcagtgtctattcaggctgctgcttttttggttatacataaattttagaatggtttttcctacttctgtgaaaaatggcattggtgattttataggaatagtgttgaatctgtagattgctttgggcagtatggccattttaacaatgttgattcttcctatatatgagcatggaaagtttttttatttgtttgtgtcatctatgatatttttcaacaatgtttggtagttctccttatagagatctttcaccttcttggtttggtgtgttcttaggtattttatttttgtgtggctattgtaaatgggattgttttcttgtattgtaaatggaaatgttattggtttatagaaatgctactgatttttgtacattaatttgtatcctaaaactttactgaagtcatttatcagttccaggagccttttggcagagtctaggattttctagatatagaagtatataatcagcaaagagagatcatttgactcttttttctatttggattccttttatttatttttcttttataattgctctggctagcacttccaatactatgttgagtaggagtggttagcatgagcatccttgtcttgttacagctctcaaaggtggggatggttccagttttgtccattcagtataatgtgggctgtggttttgccattgatggttcttattattttgagatatgtttcttcactgcctagtttcttgagcatttttttataaagggatgttggattttatggaaagatttttctgcatctattgaaatatcatatggtttttgtttttaattttgcttatgtggtgaatcacatttattcatttatgtatgttgaaccaaccttgcatttcaggaatgaaactatctgtattgcagtgaattaactttttggtgtgctattggatttagtttgcaagtattttgttgaggatttttgcatatctatgttcatcaggaattttggcctgtagttttcttttttcattgtatctttgccaggaatttgtatcagggtgatgctggctttgtaaaatgaatcagggaggagtctcttctcaatttatttgaatagtttcaaataaatagcttttttttttttgtatatctggtagacttcaaatgttaatccttctagtccatggatttttttttttggttggtaggttttttattattggttcaatattataactcaatattggtctgttcagtgttcaatttcttcctgattcaatcttgggaaattgagtatttctaggaatttaacaattttgtctagattgtctagtttatgtgcatagagctgttcacaatactgcctgagtatcttttgtatttctgtgaaaacggtgggaaagtcatctttgttgtttctgcttctgcttatgtgaatcttcctttctttcattctttctttctttctttctttctttgttaatctagctagtagtctattgatcttgtttatcctttcaaataaccaacttttggttttgttgatactttgtatgggttttttgtacctcaattttgttcagttctgctctgatttacttcttttcttctgctagctttgaggttagtttgtttttgtttttctagttcctctaagtgttatgttcgatcatgaattttagacctttctgtgtttttgaggtaggtgagtagtgctataaattttcctcctaacactgcttttgctgcatcccagatattttagcacagtgtgtctctattttcatttatttcaaataatatttttaatttctgctttaattttgttgtttccccaaaagtcattctgaagcaaattgtttaatttccgtgtaattgtgtggttttgagagatcttgctcatattgatttctttttttattccactgcagtctgtgagtatggttggtataattttaacatccttgaatccattgagacttgctttagggttgagcatctgttcaatcttggagtatgttcccaagatgaattattcgtagagctataatatatagcataggtaatatcgttaataataatgtattgcatactaggaatttgctatgggaatagaagttatgttctcactacatcagaaaaaggagtatgtcaggtgatgaatatattaatttgcttaattgtaagaatcattacataaagtatatttatatcaaaataccatgttatacttcttaaatatatacaatttctacatgtcaattatatctcaataagactgggaaaataaaagtaaaagtataatattctaaatgtagccataaatctctcaattaccaaaaatgaacttgaaagctctatctacctcaataggcggagagtttctgctttaagactcatttttcaaaatcttgtgctaaaagaggccatttatttactcctgtacattttccatagtcttctattcttccccattttcttctttcttgagtgtataatgtacttccgactactgggaaaactgtctcaaatactactgattgaactataattggctttttaaaagccacatggagaaaaaactactaagatagtcatcaattttgcagaaaatacaaccacctcttattttccaagctgtgtctacacattggcagagacaggctacgagaactttttcttcaaatttgcattgtgggttcatcattactggcaaaaataatttttcacagattctttataagttaaacataagcttaaataatgctcttcaaaccttggccctaatgcacatccttttattttataaaatataactagccccatttagagttagaaggaaaaaggcagagcagtaattgagattatttcaatttgctataataagttgagattatttgtaataattgagattatttcaatttgctatatatcttccaagtcttcaggttccaaaactgtattgctacagaagcatcagaaaactctcagctttaactcaactcccatttaacttataaaacatatctgaaaaagtaattctttttccatttgatgcatgtcttttatgatttttttggttagaaacataaaatttagaaactcatttttgcttcaaggcaaaagtatatgcccactgaaaacatcctaggaacaagttgtttttcactgaagccactcgaatgaaaacatcacaaaccaaaatgtttgtcagggatccattgagtgttagaaacagtagagaagagacataccaaacctgggagcaggttcctggaagcttatcatgtagttaagatgagaagttatgtaacaataacaacaaaacaacttttatataatatcacgcttcaatataatataacataatatagtatataaatgaattatatgatgacaaccatgtgtcaggcacctgcctaagcactttacctatattaactcatttaatacttacagtggccttacaggatgcttataattactatgattattcacattttacagataagaaaaaagacaaagagcaaagcaattttagagttagatcattaacccagcccatgtatctcccatgtccgttttcttatttgctagatgctgctgcttctcttattatatcatgtcttacaagggcagaggcaccaaatgggtgcaacagaactgcagagaatggaaggaagtcattgtggcttgaagaatttgaagaataaaagaggcatggggctaggtcttatgtgaacaggaaaaagctactttaagctcataagtgcaggcaaaaaacctagagatcatctttgtccttccctttcattaccacttcccacacattccatcacacaattatctccttctttcttctaactggctttctcattattctacttctcttcattgctactgtcattatagctttctgtcatggattttgcttgaactaatgctatagtctcctgactcacccccctgcccttgatattttttcaattcattctccacattgtagttagagtaatgtttctacaaaacaaatctgattgtattattctcttgctcaaaattattcattagctcccaattttccttaggaaaaaatatgagttccttagcatggcttagaatgcccttcatggactaaccattgcataattctgtaatctcagcctcagagcaaaccctctcaccatcaccactaccaccaccacagctcgtggcagcatacctttttccactaatgaatttctttgaattcgtcaaatatctttcttgtttccttgagtttttcaaataatatctttcctgagtatctccttcttccctattacatattatttaccattcaagtcctggcatcaacatttcttcatttggaaagtcatccataacccccaaaatgatgctaattgtttgaatgtgatccctattcttatattcttatttttatgggcagtcctcagcatactttaagataattaccggttatttgttcagttatctctaagactagaagtctgcgaggttagagacccctcttttattattcatgattttatctccggtactcagggtaccaaatccctgtctcctaagcatgcatacaaagagatgccatgcacttcaaaagtaaacacggcagggtgtggtggctcatgcctataatcccagaaccttgagaggccaaggcaggtggattgcttgagctcaggagtttgagaccagcctgagcaacatggtaaaaccccgtctctaccaaaaatacaaaaaaactagccagacatggtggtgtgtgcctgtagtcccagctactgaggaggctgatgtgggaggatcactagagcccaggaggtggaggatgcagtgagccaagactgggtgacacccagcctaggcgacagggtgagaccccatctcaaaaaagaaaaaaaaaaggtaaagatagggaaacttgaaattattgcagtgtaaattacccaagctaaagcacagaggaagaaaagactaaataaatacatccataacagagccttgggcagtgagtacaacatctagtggattaacatatctaaaactagaataattgaagacagacggcttaaaataatggcttaaaatgtttacatttggtgaaaattataaatccactatttcaggaaatttaacaactccctggtgagttttattttgctttaaccaaataaaaaccacagcaaggcatatcataatataaatcattggtaaaaatttgtattcgctggatctttataaacatccagagaataataagtacatttatatttcagggaacaacaatagcaatcatctccgacttcacatcaaaagtaatgagacaaaagacaatggaaagatagcttagaagtcttgacagaaagaaatactgtgaagctagaattatataactagacagtttttaagaaatgaattcaaataaaatatcttccaggcaaacaaaagcagagagaatttattgtcagcaaatatgcactatgagaaatgttaaagaaaattcttcagagggaagggaaataatgtcagatgaaacttatatctgtaaaatgaaggatttcagaaatagagaatgtgtaggtaaataccaagtgtatatttcgattaattttgttacaagataaatggtcgcttaaagcaaaaataataatgaactgagggattagtaacatatatgaaagtaaaatagttgtattagggtcctccagagaaacagaactaatagagaaagaaacatagaaagagagagagaaagactgactgtaagaaggctgggcgtggtggctcatgcttgtaatcccagcactttgggaggctgaggtgggtggatcacgaggtcaggagttcgagaccagcctgaccaacaggtgaaaactaccaaaattagctgggtgtggtggtgcgtgcctgtaatcccagctactcaggaggctgaggcaggagaatcgcttgaacctgggaggcggagattgcagtgagccgagattgcactgctgcactccagtctgagcgacagagggagactctgtctcaaaaaaaaaataataaaaaaaaataataaattgattgtaagaaattggcttatgcaattgctagcagtcttcataaccaggaagagcagatgttcccgttcaaaggcagtcaggcagaagaatttttttttcatctggggagaggtcagcctttcgttctagtcacaccttcaactgattggatgaggctcacccagtattggtaagggcagtgtgctttacctagtctaccaatgtaaatgttaatctcatccagaaacacccttgcagatacacccaaaagaatgtttgacaaaatatctgggcaccacctgccctagtcaagttgacacataaaactagacatcacaagtttaccccttgtcaacttggcatctataacatctccttaaattgtacttaaactccaagtaaagacaataacaaggccataatttcacctagtctgatataactaccctgtgtgaaaccaaaaatgcactaattccttccccagaaaaggaggtaaagtccttgcatgatatttacttttctttttgaactcccatagcttaattactataatgtaaagttaacaatacttaagtactacgatataaagtcaacatatcttatgttacacaataaggatataatagaggaaaaataagatattattatatgcacataaacaaatatattgattaaaaataaaggggaaatactcagataattacagttctcatttctgtaatgggtcgcatggtcatagctggtatttataactaagttcttgcactttgcctttagcaggtacctcagctctggttgtgattctttattaacaggtatgggagcaagcatatgacaggttaatatctgcatcctatgtaccaggggatatattaactttctcaagcaatgaagccacatctggtacaaaagctgcagttggattcatcatctggataaacataggataatccactttaattctccaagatccatcagtcttctgcacaggccacataaactcattgaatggggatgtgttgggaatcaccacctctgcatctttcacgtccttgatagtgcccctaattctctgcagtccctccgggaatgtggtattgcttttgatttactaggtagaggcaattcgagtggctttcacttggccattctcactataacatccctcacttcacaggtcagggaaccaatatgaggattctcctagatgctgaatatgtttattctaatgatgcactctagaactggggaaatatccaagttcatggacccagtgggccaactgtaaaaaagacctgaactaaaactccattgaccacctgagctcgataagcccctactctgactggtggatcacagtcacttggggtttcctggaattagcgtcacttcagagccattgtccagtagcctccaaaggtttgattacttctgtttctcttagtgtgcagctaccctggtaacagccataagtcctttgggggaaggttaggagacagattaacagcataaatgttggcaatgtaccaggggtcttctttaaggggccagtcccttattcaaggggttctgggtctataagccagctcaaatctaagaactgattgaggggctgtgactctctgtttttatgattcaagttagactttaattcacttgacctagaaggtctctgcttatgtagatcgagtatgaacttagtagggcttcctatctatttcactctgggaacattatcatcaaatagccaatgtcaccaggcgtgtgtgtcagactattctgagtgctgctgtgcctctgctgtttattatggtaaccactcccacctcgctttgggcaggttagtgctgccacttggccctgacaccctgggattcaattactccactgcattctgttatccaggtcagtgactgcagttcccaccgtaaggtctggcctacagagaaaagttatcacaggctctgcaaggatgctggggctctcctcacaagtttatttctcagaggattagtgaaaggtctgtcttctgaaccctctgaggataggtgagtaggttttaaccaacaaatggtctctaaccttccaatctccctaacatttcaatctttcctttgaatcccttctcctacatacaaccaagacaggtccagaatttccaacttgcttattgtgggccatcttttggtccatatttaagtcaacaaactggtagagccctttttatctcccagagctacagcattaactgcaggatctctgcttagtcaaccaaggtcaatgaatttgacctgatccaattttatgttccttctaccattattccacacccttaatatccattttcccacacgttccccagatttctttctgtgcaagttaaaaaacctcaagtaggtcttctgaagtgtagtaaactcttataagtcacactttgcacctcaccttgagaagcctgctgggaccggagtgaagtggcaggtctagaagcaaagaggggtggtagggtggggtcctgataagaacagcattgtgttgcacgcctcgggggaggccatgacagtttccttgagcaatacagggttaatctcctcagacacaggtgaaaaggcaactttccctggcagtgggaaggctgcttgcactggagctaggcctcttccactggccaaaaagagctaccagaatttaggggctcaatagctccagtttcatcagtttctcccacatgtccctgtttcatacttcagaattctatttcttcccaatcgcttcctcactttaacagtagacgccctgcaagtctggcagtttacctcacgttgtaactcagctggtcacaggacaagattcaggcttgattttcagcagtctcagccctgtggctagagggatgaggcctcctgagctggtcacaggacaagattcaggcttcattttcagcaatctcagccctgtggctagagggatgaggcctcctgagctggtcacaggacaagattcaggcttgattttcagcaatctcagccctgtggctagagagatgaggcaagattcaggcttgattttcagcagtctcagccctgtggctagagagatgaggcctcctgagctggtcacaggacaagattcaggcttgattttcagcaatctcagccctgtggctagagggatgagtcctcctgagctggtcacaggacaagattcaggcttgattttcagcaatctcagccctgtggctagagagatgaggcaagattcaggcttgattttcagcagtctcagccctgtggctagagagatgaggcctcctgagctggtcacaggacaagattcaggcttgattttcagcaatctcagccctatggctagagatgaggcctcctagagggcacacattgaagttttcaggtcatctattgaacccttgagctgggagcttatttctttcttttcccacattgtccagtgacattaggagcaaacagccaatatcattatactcattattttgacaaaaatattgaagaatattgtatacacactcaccctgcttcttataagcggttgattaggggaatctaatggtaatattttgcaaatttctactgccagatcatgctatgaactgtcaatgctctccatactactggaaatagtcattggtacctctaaatgtaagtgaggggaaaataggatctggaggtgagagacaggactagctggatttcctaggccaactaggaatccctaagcctagctgggaaggtgaccacatccacctttaaacacggggcttgcaacttagctcacacctgaccaatcagagagctcactaaaatgcgaattaggcaaaaacaggaggtaaagaaatagccaatcatctattgcctgagagcgcagcgggagggacaaggattgggatataaagccaggcattcgagctggcaaccgcaaccccctttgggtcccctccctttgtatgggagctctgttttcactctattaaatcttgcaactgcactctcttctggtccgtgtttgctatcgctcaagctgagctttcgctcgccatccaccactactgttagctgccgtcgcagacccgctgctgactcccatccctccggatccagcagggagtcagctgtgctcctgatctggcgaggcacccattgcagctcctgatcagggtaaaggcttgccattgttcctgcacggctaagtgcccgggttcgtcctaattgagctgaacactagtcactaggttccacggttctcttccgtgacccacggcttctaatagagctataacactcactgcatggcccaagattccattccttggaatccgtgaggccaagaaccccaggtcagagaacacaaggcttgccaccatcttggaagcggccagttaccatcttgggagctttgtgagcaaggaccccccacccgggtaactgaggcagggaacatgagatcgattcacacttcagctatgagagaaaatatcctctccatttacatagggcatatgctcagtaaatgactttgtaactttacttcatcctctacatttatgtagagtgtacaccaagtaaccaatggaaatctctcaagggtatttaaactccccaacattctgtaacagggcccttgagctcctatgctcgggtccattcccacactgtggtgtctacttttattttcaataaatctcttaattcctccctcgctttgcttgtgtgttttgtccagtactttgttcaagacgccaagaacctggacaccctccgccagtaacataagcgtatcagagagcagattttagaaagcctgaaatcaacccagacaactcattctcaaaattctttctccagggcaacttttggtatcaaaagctatatgagttagggttctccagagaaacagaatagatgacagacagggagatagatagatagatagatagatagatagatagatagatagatatagattacatagatagatacagattacatagatagatacattgagcaagttcattggtgccatttttcaaacattatgtgttcacttcatgtccgcatgtcagcatattttagccataaatatttttaattaaggcatatatgttgttttttagacataatgctttgcacactgaatagatgatagtatagtgaaaacataacttccgtatgcactggcatccatgcacacaatacatatgcatatttcccaatctatacatagatattagtgagcataatggagaaaagaatcatcaaagcaagaattattgacttcagatgggattgtgctaactttctctcacttctcaaaaccaagtgagaattctgagaaattcaataagggacaccttgtggagcaacaatgattaccttttgtgatgagattgtaaagataatgacacatgtataataggaaaaaaataagcattgctttctataatatcttactgctgcccaagaggcccattgttggattggcaccaatggtagctatggagaggcaaatgtagatgtggaaactgggacagggactaaactactccacataataaggattagaggaatttgaggtgtgaagggtgagaataaagggaggaatgtatgaagaagaagctaaaaatgataatttaaagctttgtaggggcaagaacagagtaaaaaacctatgctgatggttctgaaggaaagaaaatgtaatttttacttcagctctcataagttcatagttgtgacagactcctacaacaaaggacaaggtaacgagaaaaacaagcaagttctttaacacatgcagggcatcacatggaagaaaagtaactcaaagcagtagtctaggagtctggcttatacagcatgtcaacaaggagcagtaggtttcacaagtgaaaagacaaagaaaagcagttacaggcttccattggtgggaaacggtaggaaggtaaatatatggaaatacactaataaagtcaagtcggcttgagattgctctgggccatttctgggctgataagagttggaatggagaatttacatactgtctttaggggagaaaagaaggagagagtaggaaagtgttttcttctgtaaatctctatcctgcttttaggcaaacagagggaaggcagagactcccctgaatcttcattgtcttcagctcaacaatatttatgtcaaagaagcacattttgagatgacaccttctggtttccttcagtctcccctttgaaactttcctttcagaaagttttacatagaagagccaagttggtagctttggagcaatttggctaggggttgtgagataagggattggcaaaggcagagaaaaacatagattgaaacaaacagaaaagaacaaatttgagtaagttatcccatatcttattgaatcagtctctgagtcctgggaatacatatggtatttaaacaggtgtgtttcatttcaggatgtggccttgcacatgtgttcccatcaaaggcctccatatggtgcaggcaaatatatttatgaagaagcatttctatggaaataaaagaaaaacaaaagattaataattggagccatctacaaactactatctgagtctggagggcagccagctgagaagatttctagatgttcaactcaagcatctttttttttttttttttttttttccagacgaagtctcactctgctgcctacactggagtgccgtggtgcaatctcggctcactgcaacctccgcctactgggttcaagtgattctcctgcctcagcctcccgagaagctgggaccacgggcatctgccaccacgcccagctaatttttgtattttctgtagagacagagtttcgccgtgttggccaggctggtctggaactcttgacttcaggtgatccttccacctcagcctcctaaagtgctgggattacaggcatgagccaccacgcccggcctagactcaagcatctttagttgaagcaggagcaggcagtggcaagctgacaaatatttctggtttgccatttaaatgtcgtaaagcttgtctataaataagctgttgtgatttcttggaagtttgtatcaagttgtctggcttctgcttggaaaagcacagtgttagttttcataatttcaaggcagaaataatggaagaaaattttcaaatactagtttggaaagtcacagccagacatttgagaaaactaaaagaattcagaatccagtccagtttacaggtaaataataaaatctcaaaaacaatgaatatggttagaatctaattatcaggtgcataacagtttcctatttcttttttatgaaatataaattttttctctgtagtccccctatttttaccaaagataataatggtaagtccaatttatttgcaaagtaagtttggtccctcattaaatttagcttgatcacttacatagtacagcaagaatggtgattgatcatataggctttttataaatttgctttgctggatctttttataaggaatctcacattagacttttgaaaacctcttacaactaggaagctaagctaaggactcacgatcaaacgttgccagtaatgcctgtcaatgagcacgaatacatgtgttctggaggttcctcaaagtatcatgagtttcctgggcccatcatgaaccaacattgtttactcactgtaagtacagaaacgttgtaaggaaaccatgtattcaaggtaccaggccagttttttcaaggggcttttattggctccataaaatcagccttaatttcttaaaactctgtggtcatgtctgaaaatatgacattcctggcagctttggtaatgtaatcagtgtttccaattgttgcctgctgcaagaagaatatatttttattaaacttatacaaataactatattgtcatagaagtaagaatacttctaaatagttttcaaatttttaggtagggagaaaaggtaattgttttaattctgctcacaaaaatatactttaccaaatgccacaagctatagatagcttaagagaaaagttttccttaagtctggaaaataaaatataaaatgaatcagcaatgtttcaaagaaaaatctatttaaaaattataatccttcatcagttctgtgttgtgcaatcaattcttttgcttgatgttaacaattttattaactcacttttcccattagttttcaaaattcttatccactcaacggagtgttcttaaagttatcagaaacttgcttttaacagtacttatcagaatcttcacaattttctctgaaaaagaagtaattttggactgtagctgattggaaaaaaaaattagataagaatcaaagctgttggctgggtgcgggggctcaggcctgtaatcctagcactttgggaggctgtggcgggcggattgcctgagctcaggagtttcagaccagcttgggcaacatgatgaaaccctgtctctactaaaatacaaaaaaagccgggcacagtggctcacacctataatcccagcactttgggaggccaaggtgggcagatcaagaggtcagcagatcgagaccatcctggctaacatcgtgaaaccctgtctctactaaaaatacaaaaaattatctgggcggggtggcggggcctgtagtcccagctactggggaggctggggcgggagaatggggtgaacccgggaggcggagcttgcagtgaaccaagatagcgccactgcactccagcctgggcgacagagcgaaactccgtctcaaaaaaaaaaaaaaaaaaaaaaaaaaatcaaagctgctatctatggatgacaaagacttagaatgacgtctgaactctcatcaggttgttagcaatcttgtgaacccagaaaatctgagacaggtctcagttaatttagaaggtttattttgccaaggttgatgatgcgtctgtgacacagcctcaggaaatcctgaccacatgtgcccaaggtggtcggggcacagcttggtttatacattttagggagacacagcaatcaatatacggaagaagtacattggttcggagacacatcaatcaacatatggacgaagtacatgggttcggtctggaaaggcgggacaacttgaagcaaaggcaggaagactccaagcagggagggagcttcccggtttcaggtaggtgatatacaaatggttgcattcttttgagtttctgattaggctttccaaaggaggaaatcagctatgccactatctcagtgagcagaggggtgactttgaatagaatgggaggcgggtttgccctaagccatttccagcttgagttttccttattgattttgggggcccaagatactttcctttcacattccccctcttttcttttaaaaaaccttttggaaaaagcattttacaagaagatgaatctccggtctcaggtttcatctgatctctcatgactagaacggtttattcctagatggggaggtcccaaaagctcatttttagcaggttgtgaagtctcatgtcctgtgaagagaaaatagtgggaaggaagggagaaaaagcaacaacaaacaaaagaacaatcctggaaaaatcgatataggccacgttacgctgaagtccatacattagtaggcaggtgtgaaagtggcttttggatgtgaataagtttctattattttcttctgaaatttaagttgtgtggcttcagtttggagggtttaaagaaagcacagcttagttttcagtgactctgaattaggaaaaatgaaaaagaagacggaaaaaattgaaaatgttattttgaatacttgtagccaagaaaaattataattcagtccaaactgtagaaaataataaaaattaaaaaaaaaattaggcaagactagaatctaataatagatgtactatagttttgaaacatatttttttctctccagtttcccatttttaactaaaattatggtaggactggttgcctttattatacttggcctaattatttgtatatagtgcagcaagaataattatttttttacataggcctttacattggctttgatggaactttgttccataggaggaatctcagacaagacttttaaagccaagcccagccatggatttgtaccatcaaatacctatgggttgggtgaatttcctctcctctggaggttccaagataaacctggggcttctgcacctgtcagaaagtgacattctttacttcccacagatcacaagccctgtacagagactgtgtacacaaaatatgaggctagtttccaatggctttattggcttcataagtcaagtttgattccttaaaggaaagcacaccattccagtcaaagccatggtaaaataaccagtttcttcaattgtgtcccactgcaaatgaaaacagtttcttttttttgacagagtcttgctctgtcaccaggctggagtgcagtggcacaatctcagctcactgcaacctctgcctcctgggttcaagcaattcccctgcctcagcctcccaagtagctggaattacaggcacacgccgccacacccagctaatttttttgtattttagcagagatggggtttctccatgttggccaggaaggtctcgatctcctgacctcgtgatccacccacttcggcctcccaaagtactgggattacaggcgtgagccactgcgcctgccctgaaaacagattcttattgcacttatgcaaataactgtattgccacaccttaagaatactcacaaagtttccaaattctggagaaatcacataaagagaaacaaatgtgctccaaattttgttcataggagtataccaaattgttaaaagctgccaatagctcaaaagaaaagttttgagactctgaaaatgaaacaaaggatcagcaaacatattaagcaaaaagtcaaaaagattggtttagttcatgcagcgaaatcctgttctgcttgatactcttgaaaattttagctctccatgagtcctgaaactttttcctctattctgatgtcacaatctcccaagttatcagaaacctgcatttaagagcacctgttggagttttatagctgattataaaagcaccttgtaaaggggaccaaaacaagacaacaattgtccacaggtgaaaaaaagttttaaggcagtcatagtcaaaagacacaattgacaaggaaacttgttacctctggcacacaataatttttacataacaattatgattattactcacaatatacgctgttatatcagaattacatgagtttcccataattttggaacacataccaataatcaacttatacaaatacagcccaaagaaaaccaaaaatatttcatatttgacaatgctttctatataatttttataccaaataagccaaattatgtcatttttggactttaggaaactaatatcttaaaggattaattaggttagaaagagacataatttataacttgattttggaaagtttgtcaaatataaaaggtttaaaacatttgatattacaaaataagattacaggtcattgtaaaatcatttatttaaccaaaatgataattcaaggatttcaaaaaaaagcaaaaaccttcattcattgcaagagaagacttaattctctaaacaagaagccctaataaagacagagtgaagccaattacatttgtttttcaaaattttgtaaacaatctataaaatttaatcttgattataaaacttccataagccttttctaacctttataacctttattaaggggttggttcatgcttcaagaaaaccttgctaatctgacacaggggtccatatactggttttgcatcagcgtgcctttgacattaataattaatttgtagagaaactgaacttactttatctttcaaaattgacccttacaatcttatgctcccacctcttttgcaattgtccctgggtcttgaggagttgcatagctttaatttctggccctgtgtctcaggaatgtagtttgttttgattggcatcctctatggggcctgaagatgaggctttaattgttgccagtgtttaagatttaacaggacttgttgtcctttttagaccaaggaattaaagccctctaactcaatgttacaaggactttaaaagcatatacaggaagatacgtggatataataacctcaatttttaaaaaaaattatctccatttttttttcctaagcaaaccaaaacttaataataatatgacagcttgattatataaaagtttttgggttttttaaatatataaaccctcttattgtgactcacactgactgctcatcagactttctgatttgttttgaatatcccttctttttaaacaaccagttatttcattttagaatgaaactatacaagattctttcatatataatattatttctctttaagctttttttaacctcaaaaacaatctctttattttgataactttctttacatcttttttatttcctgattccttttaccttgttttatacataacctttaaataagctttgagttagacaaaacttgttcacctttaaagaaaaaaataaaagagacacacttgttttttgtttgtttagcaagaatgttttcctacaatatatatttattggaaaatacccaaataatgaaatatcccttatttggtttaatgtaactttataatctaaattatggccagtttgtctacaagtatttatcccattatatttacctaattattttattttgtttacatagattctttatgaaaattgtgatagtcatgatttaaagttatgaaaccaccattgcaaaattataactgagacagtggaaaaagatttaacgtaactgattccatattgctcttaacctccaggctgtccttgttcattcctgggctcaggctgaactacctttgggaggaacttagtttatagtttagctttgaaacaaagatgataacagtcgttttgcaaaacaaacctccttattgtctgtggactaaattgcctaaagccacaggattagaagttatggtaaccttactaaattcaagatggaactattttcattaaagtcatattgatgtcttatttattaaaaattacacaagcaaagatcattctgttttggaccaggtttatagttttgtaacccctatgccaaatttttaacaccttatagtgtttggcagggataagtatgaaatagtttaataaatgcaaacaaaaatgtatgctggcaattcttttttttttttttttttttttgtgacggagtctcactccgtgtcccaggctggagtgcagtggcacgatctcggctcactacaagctccgccttccaggttcacaccattctcctgcctcagcctcctgagtagctgggactacaggcgcccgccaccacgcctggctaatttttttgtacttttagtagagatggggtttcaccgtgttagccaggatggtgtcgatctcctgacctcgtgatccacctgcctcagcctcccaaagtgctgggcttacaggcgtgagccaccacgcctggtctatgctggcaattcttaagacatttctaatatgactttaccaagttagctcatgctggtcccaagcaccgatagatttgtcaaaggtcaggggcatctccactcagaatccccgcaatggttaccgaaatgtgaacccagaaaatctgagacaagtcttagttaatttagaaagtttattttgccagggttaaggatgagcctgtggcacagcctcaggaagtcctgacaacatgtgcccaaggtggtggagcacagcttggttttatacattttagggagacgtgagacatcaatcaatatgtgtaagaagtacattggtttggtctggagcaaaggcaggaagacttaaagtgaggaaggagcttccaggtcacagataggtgacacacaaatggttgcattcttttgagtttctgattagccttttcaaaggcggcaatcacatatgcatctatctcatgaagcagaggggtaactttgaatagaatgggaggtgggtttgccctaggccgttcccagtttgagttttccttagtgattttgggggcccaagatactttcctttcacaatttgctaagagtttattataataatgatacaattgaccaaaaaaagtggttatttctgtggcatacaatattttaacataaaaatcgtaattatgacagataacattttaatacatacatattatgtataagaaatcttacagaattttggaacacatgttaatatactcatacaaagataactcaaaactgttgaacattatttcttatttgacaattcctcccatgtaatttaatataaaaaataagcctaataagtatatcttttatatttcctttgggaagttccagggtcctttgggacatctcaaagttacactaaggtcaaaaagacttaatttagaatttgatctttgggaaattcatcttacagcaaaggtataaaacacttgattaaaatataatcacaggttactatgaaatattagtcatttacttaactggagtgatatttacagatttcaaaagcaaataaaagaatttatagacttgtagaaaaaccttaactctttcaatattcacttttcttaagtaatcagagacctaatgaagacagcatgaagcataggaaattatcttgatgaaacacagaatttttctctcttctttctctcctctcactttttttagtttacttaaaagagaaacaaaaatattttactgtctcttatcaattccacatgaaaattttgtttttaaaaggtcatgttctacttttgcatcagtgcacttttgatatgaagatttaatttttagaaaaacttataaatatcatctaagtttagccagcttgatatacacaaaatttctttcacaagatttatcttcaacaaacctttcacaactttctaatccattcattttatctatatcactccttttgttattcattcattctgcaaaaacatctaaataacctccaaactaagcaaaactctccttcctcaataaaagcatatcataatatctcatgacactgtaattttcttgtatactttgtgtacagaattatttccttatctctagtagtttaagttacatattagaattttaggccttataacttaatttccagtaaaaatccaggaagtaagatattttgaagtcttatttaccagtattttataagtacatattttataatttctagagacataagctttctcttagaacaattttttcatgtggaacaggacatgtttactaacatctcagatatatttgtctttatgtaaaatttaagaaaccaaaagtaaataaacttatgttcagcaattaatgtttcagtattttatcttatttggaactgatctagatcttcaatgagcatctgtcatttaacttagcaaaactgtaagggtataggtagagacttgagaaactaagtaagcaccttataaaatatagctttttaagagtatttttataaacttttacctaacttacatcttatttaattcattcttttttaacaattatgcctggaaaatttatgagacattagacaaagctagtcatcaaagaagataatctgtttgatttaaaagtcacttataggccaggtgcagtggctcatgcctgtaatcccagcactttgggaggccaaggcaggtggatcacctgcggttgggagtttgagaccagcctgaccaacatggagaaaacccatctctactaaaatacaaaattagccaggtgtggtggtgcatgcctgtaatcccagctactcgagaggctgaggcaggagaatcacttgaacctaggaggcagaggttgtggtgagccgagatcataccattgcactccagcctgagcaacaagagcgaaactccatctcaaaaaaaaaaaggtcacttattagataaaagtctaaaggtcctctaagttcttgttgtcttgaaatcactctacctaccacgttattaatttggaagcctatttttccctgttttggccagaaaaaatttaaaacttacagcaagcttttgaaatcagtaacagttcttttttcttgtgtctataggtctgtttaattgtctagttagtgtaggtgagaaatggctttcaaaggttattttcagggttggtgttttgttgttattgttgttatttttcttatccatgcactgcagacaaagcatttttaattgtcagataagcataccttttcttgttgttttcagttcaagattttggccaaagcaaaatagtggtttaaaaagtagacttggttaatctgtgttgcagctcttcactcttgttgtttggcaagtgggagggagtgttacagctcttttattcccaccatgggcaagcgccaggctcttgtcccatgacaaggaagaataaggcacatggacaccagagagagtgaggcagagtcagatttactaaatgatagaaaagcacttagcagagagaggacccgaaagccacccatgagtctgagtttgggggtttttatggactgcaatgtgagaggagtgtgctgactggtctgcaagctgtcttggagacagcaccactcaaaaagaggtatgatagtgtaaacagccaattgaaggcagaggtgaaggcttggcctgggacgttggcctgggacaaatcagtggctgaagtgatgattcactctatgtaaatgaagattcagcttgttgtcaatcacagaaaggtaggcgtatataaaataagtgaaaagtaagagactaaggtgcaccaaggagagagaaatgtgtccaaaaaggaagtggaatttgttcatctgggttcacagagtaggtgtttccattcaaggatgctggctccttcttatctggggcctgcagtttgattttcaggctgttcttggtttgaaggagttttaccagggacccaccctaattgcctgcctgactggtttcttcctttctcctctctcatgagagtcatcaacagattcagaataaaagttgtatgtctacagtgtatttattgctgatagatatgtctgcttaaattaaaccaatagtattaaactagtattatttaccaaagatttacccaagtaacataaacttagaaagcatttgggttagttcctatattttatcatctttaagcatatattttatatgagtactcatttatgtctttagccaattaaatagactattttaagagattttatatcatatagacataatgtgcaagtatacatatacacatgtataaatatacacaaacatacagatagacacaaacaaatatcttgtagcttttatttttaaattttagttaagagacaggtataatagtataaaacttactagtctataaaaggacagttagatccattagaaagaacagagatgcctcaaaatatatattgatagattgataggcatagcctgaatatcagcttccaattaaactaacttttgaccatagacctctttattaaaaatattcttttcaaatatttttattatcaaatttagctggggcaaacagcaaacaattctgcttcctagcttctcgttccctgaaatttgcatttgaaaagggatggtttcttggtaaaactgattaggaaatttatatctcaaaggctcagggaaatacagttttcaccaagaaggtattttggggaggtatatttgcctattaaaggtctaggataattgctattcaaaattccttttttaaaaagtgcaagagagccctgtttcctgatgcttttcagtatcagataacatcctgaggtgaataggtgaggtttggggttttctttgaattgctttaaagcaattaaatttttgtttttgtaaagactcaatttgtaagacaagaatagttactttttttttttttgagatagagttttgctcttgttgcccaggctggagtgcaatggtgcaatcttggctcactgcaacctctgcctcctgggttcaagcgattctcctcctgcctcagcctcctgagtagctgggattatagccatgcgccaccacacttggctaattttgtatttttactagagactgggtttctccatgttggtcaggctggtcttgaacctacaacctcaggtgatctgcctgcctcagcctcccaaaatgctgggattacaggtgtgagccactgcgcctggcctaagaataggtacttctaattcccttaagaattgggtggcagcctgaatgattttaagggactgtcccatctatccaactatattatctttaacttatttctctctatcaaggagcagattttcaactaagatgaaaatcaaaagatctttctgttccagatatagacttaattacctttgaaatgttttaatatttttttttctgaatatatcgttccattttagctaaggagacaaggcaaaaaaagcaaacagaagtttctgtaagaacgaagtttcaaaccaaaggtatacctggaaaatgactcaaggcaaaattaatacttaagacaaaaccaataagactttaaggctttaattaacatctccaaaaaaagagcaaaaatatgcatccctttcaaaatacagaccctcccaaaaaacagccaaaagcgagaaaacctttgccagccacaaatagggtacaacaaacattttcctccagagacattcttaagtctcccaaccttttggctggctgcctgcaaacaaaggcccaataacctgtgggcctttggtggatgcaaagtcataaagacaatagtcagtaagacaaagagaaagacaagcttgccattaggtgtagggggaaggatcactaatgtaggggccaagggaagacttcccccacttattgtagggacaataaatgattaccagagagaacaaacggatcagggagcagagattaacctgtaaatgatcctccttggaaactgagcctgaaagagggacattatcttgtgaatgggtctggtcaggtgtggttccattcttcagtcttcttttctataataaataataagatgacatggaggggaaggaaacacaattgctccctgtggtctttatgtaggtggggaaggtctgccagcatctgttgatctgtaagggcccgtaattcaaaatactgattataccagggagccatattttagagtaaaattccctgcactcctttactaacaataagcctttatatgacttaaaaccacagatgcaagtatcaggttccaaagtgggtgcaaaagatgcagcccctcaagatctaaagtttttacctaagataccctaggaaagcaaaaactctcattattaacaaggtaacgaaggttgaggcaattaagacaaactcctgagagctggcatggtgagacaaatgtttggacttctagctagccggcataagtacaacaacttgtgatccccaggctggcccaagatactacaaagactaacctttgagacacagcagggaccccctattagggccctgagagccccccaaaaagcatggaaatatggaaagatcttgagttccttcaaaggaaattccaggcacatagctagccctgagaagtaaataaacaacttattaaaggagataatagtagcctgaaacgatggccaaggaagctggggtcaggagatgtttgctttccctatggaaactaaggatgacatcttaacatatgtccctgagttgtctttcagaaacatggacccccaccaggatccccacagaacagattcactggcatgtagacctcaaatgagggagaactgaaggctgaactgtgaccaccactctttgtcccaaatgtcttcctgagaggcctggtgggagtcacacccatgagctggttaacattcttttctgctgatccctaattttaaaataaagcttctcttccttaatcaattgcaaatcagaaaatctttgaatgtgcccatgacttgtaagcccttgctacaggatttcccacccttttaggccagaaccaatgtaacctccatgtattgaattatgatttttcctgtagcttctactcctgccttgaaaaattcttgcctgcaaaccatttgggaggccaggatttgaagatgagctgtctggtcctgcttgtttggcaccctgaaaataaatgacttcctttctgccactgcaacctcagtgtggatatctggttttactgtgttgggtgagtggactccagttctgtaacaccttgctggttacaaagccaaactctcaaaacataaagaaaaacaaaaggaagatattttcataattttcctccttaagacaaaccacacaaaagacagagataaggaaaacaaagacctcctggaaggctaaagatcaataactaggctgggcttggtggctcacgcctgtaatcccagcactttgggaggccgaggcaggtggatcatgaggtcaggagatggagaccatcctggctaacatggtgaaaccccctctctactaaaaatacaaaaaattacccgggcgtggtggtgggcacctgtagtcccagctactcaggaggctgaggcaggagaatggcatgaacaaggaggcggagcttgcagtgagccaagatcgcgtctctgcactccagcctgggcgacaaagcgagactctgtctcaacaaaaaaaaaaaaaaaaagatcaataactaacaggtgcccaaaccaaatccacaagagtcaccaattcaaataattaattattttttcaaaatcatttttttctgttgcaaatttgaatttaaaaaacaaaaaaaataggagttttgttttttttttcctttctctctcagcgaggcactacacatagagatacgagagagctcactttggtaaaaattctcttttttctgccagcttctgccacttctcccaggatcacatctgcagctgtcagggcaagtggagtgtgccagaatctcttggctagatcaccaaaatcaagcagagaaaataaaaattttaactcaatcctcccaagttcacagttggaacagactcctgtaacacgagactgattaacaaaagaaaaataggtgacttattaacacatgcagtgcacatcacctgtgagaaaaggaactcaaagcagtgatctaggacttacataaacaaagaacaataagttttatacaagtgacaagacaaagaaaagcagcaccagacttccaaacaccagaaactgtgggaaggtaaatatatggaaatacactaacgaagtaaaaatctgctcacagattcctctgagccatttctgagctgatgagcgttggagtggagaatttacatccgtgtttatgtgagaaaacaagggaaggataggaaagatgttttcttctatcaatctctgtcctgcttttaggcaaacagagagggaaggcagagactcttagttgagaatctaagttgtcttagagaatcttagttgtcttcagttcaacaatatttatgtcaaagaggcatactttgaggtgacacattctggtttccttcagttcaaagaccagattttgaaggaaagacatgactgataaagattattcagggatttgttcctctctctttagtacaaaatagctataaaatttatgctgttcacaaatgctgggggatttgaagagttgctgaattttgagccaaggacatgtgtatgtatataaacaatgacatgtatatattttttctttttataaacttgtaaatttcttgaaatccaaaataaattcatataaatttgtcctccaattgtgacttctaagaaatatttattaaatgaaagacatcctaacaatgacactaactcgtcctccagacatcattacagttggctccttgtcatcatttggcccccagtgcaaatgttcctcctcagcagtgctatagaaagcagctccaccttccctaggcaccctctacagtatcatctattcattatttaattgttttcacagtattaatcagaacctgaaattatcttattcaagtatttggttactgacatgaccactctccttcatcctggaagcattatgataactaagacctggtatgttttcttaccattctactcctagtcccttgaacagtgcctggtatataataggtaaatactaaatatttttcgaatgaaggaagggataaataaatgggttcagtagaatccatttcactcaacggaatccaactgaaaacatactctctagtcagcaaggtttttaacatgcagattagaagctctggggaggggttgattgtatctaggaggatgtacttaaatttcttctttgggcataggggcttctggcaaattttgtagcaaattagtatttctattggaatcctagtcagatatttctgagttttagacctaagtagttttcacatcaattatgaaagataaaattatttcaaaagatacttgaattcaaatctagtatatagagtgaatgcattttaaaagttaaaaaaataagaaattaggttatatttgaaagaatctcagctgaagatttttgtgcttttattacaaaggaagaggtaccactctcgccggttttacatcttgcattttaaaaagttaagtacagccagacacggtggctcacacctgtaatcccagcactttgggagaccaaggcggaaggatcctttgagcccaggagttcaagaccaggctgagcaacatggtgacaaaattaaaaaataaaaataaataaaaatgttaagtagtgatacgagaaaggagcaggaaagtgctgggttgagaaagatggggtccctggtgagagcttcactctcgagcctgtgcccacggacccaaatgaggacaggcatttctgattttgtgtccaaaaagttgccctttggcccacgacaccccccatcctgtgcccataaaaacccaggacccaacaggcacatacacaagtggctggacattgagaggagcagaagaagacacactggcagacatcagcaggccagtgataatggaacgacacagatgctgaggggaattcggccaggtccagtcgaagaagagtccagtgctgggcagcccgactccaggggaaggccacctttccactccatcccctttccagctccccatccatctcactgagagccacctccaccactcagtaaaacccagcacttgtcctccaagcccacatatgatccaatttttctgatacgctagagcaagaacccgggatatagaaagccctctgtccttgccataaggcagagggtctaatcgagctgattaatacaagcttctgcagacaacaaagctgaaagagtgcactgtaacacgtgcccactggggcttcgggagctgtaaacactcaaccctagacactgccatggggtcggagcccagaaatgctccccacaacctgcctgcctgcatgctccccgtaggggtttgggcagcagggcaagccatgcccctgtcacatgccctgagaggggggataagggaacttcttctgttttagtaggaagtactcgtctagctttcctaccagttaaaaataaaatcaaggtcttttggcttgtgtacaaaaaattcatcaggattgtagttattgtaatgcttattaataatctacaatggatcttcagttcaactcaaagtcatgatggacactgtttggcctccagctatgatctcagccttagtgttgaagaaagcccctgaaatacgggcagacagtgatattcagagccgcatgtaaagagcctttcggaaatcccctttgctctgccctgtttcattccacatccgtctgcaccttagccagcattgcatctattctaactaattggttcttaaaatgataaagcagaacaacagataacaataagaaagtcctggactgtgggcgcttctatttgtagagaatggaagactaactgagcctatcaatattttagtctcaagagcattacccctggacagtataatgctgctaacttgtctagagaagtatcattgtacgtgctaagtaataggaagaatatgtctagcatcaattataagttgcaattcacactgtgcagggtgctcttcaaagccgcaataccttcatccttacacaactgtaaatcatgattttatttcagaatagggtctctgcttttttactcactttgaaaagaatctgacacagtgtgaaagtgaacatttaataagtacttccttctacacctgcacacagggaatggatgataaatgctgttgtctgagtttatcatgataagacgaggcacaatggagagacaattaatgaatatcctttgattgatgataagacaagcagtacaaatatggatttttcttcttttgcagctcttctcaaatagctctaaacaaaagcaaaacatgctctggccacagaaaagacttacgacacaagattatttcttattgccattaatttcatcttaatagacattattagcttattacacagattatattatattatatttgcataaatttatcacatagcttattatgtgccacacaccatttacatgctatatacatgcaaatgtgtttagtcctcaaatccaccctaataataatgatggtgataatcataacatactattatgattcctatttctacagatgaagagaatgcacagagagaaagtatcttgtcaaagagcatggtgctagtaagtgtcagagtcaggatttgaacctaggtagcccagtacctgaatgtgtgtacttacactatttatcatttatttatatttatttattgtatttatttttattatttattatcatttatttatttttatttttattttattatttatttttattttttattatttatcattcatttaatatcatttagtgtaggaacaccaaatgatgtagtgaagtaattttctttaacatgctcaacacataaaggacttcacactataataaacccagagatattttaatgagctccataggaacatatctctaagttagtcatttaacttaaaatcccactgtacctagcttccactattagtaaatcaaagagtgttctatcaaaaaattccttttctccttacctccaaccctccttatttcatagaccttgcctaccacactttctaaatggagatgtagtcccagttgtatttctactgttcagagagcgaacaggcatccgtctccaactacaaactatacacttgtgctacgtgactgagaacagcatgtggatgcaagttcaccttggaattccaccacaatgaagctgtttgtgagccgctttctgcttaaagaacactttaagtttcctcagtaaacatcttttcataatgtgaaggtaatctcaaattttatttaatactaagtaggtcataaaaagttagagtttataagtttcatttgaccatttcttgttgaaaagattttggaaatgaggacataggtctttcttgaggcagaaagcattatggatataaagaaaaagataaagagcatagggtcagagagacctcagtttaaattttaaacacatctgagcctcagtttgcacatccttaaaatggggtaaatactacacctgacacacataaggtttatctgtaatgtgcaaattaacaatgtccttgccaacataatatttaaaagtctgctttgttcccaaccttgttagaatttccatttgggtcttctgcacattatttttcaataaaatgctgatttttcagtccttgaccctcttctcttaactcttggtagtaaaataaatctctactcagacaattactaaagttccatctccagcctggacctctcccatgaaatgtgactcatatattcaactgtctgcttcacttctcttcagaaatattataatataataatattattataatggtgtaatatataataagtatctcaaatgtaacttcttcaatactacacttttgacttggacactcaaccatagttcatgctgcagtctttcttatcacaatagatgacatctcttgcttcttagtacacagtcctaaagctctggagttgtccttgagacatttttctctgaaacttatatcttgacaacagcaaattctatctattctacatgtttaaaaatatttggctgcttcaaggtcagaaagatattctcctatttttttcttataaaaacatcactgtttaatctttcatttttagatctggaattatttttgtgtgtattgtgaggtagaagcaaaatacattttttgtattgatttccaactgacctacagccatttattgaaagggtcatcctttctcccactgccttttttgtcataaatctagattctctactcttttccgttggctttagccattggcatacatagttaagatttaattactatacctttataattggcatttatatctaaaaatgtaaatcttccagctaaattctgttttccttgactattcttgatcatttgcaatttcataggaattacaaaatgagcttgttaatttatgtaaacacacatgcatacacaccctgctaagatataggattgagattgtgtggaattccagatcagtttagagagaattgacaaaaatgggcacaagactgaaccagcacttaagaagagtatatccaaatgaccaataaatatatcaaaactttattcttcgtcagagaaattaaaattaaaatcatattaagattccactacatatttgccaaatgtctagaatgaaaaacacaggtaataccaaatgttggtaagaatgtagaacaactagaattctcaggcaaaactttggaaaagcatttggccgtgtctactagaaatgaccatatgtatctcctatttcttggcaatttcacatctaaaatatgtgcaacagaagtggatatttatgtccaccaaatatgtatgtatgtttgtgggtttgtgtatatacatatatatagaaaactgaatgagagtcaacaataggatggataaatacattgtgctatagtcatacaatgaaatccaatacagcaatgacaattaacaagctacatctatacaaagcagtgctgatgagtctaaaatcatagtaggcaaaataagttagacccaaataatacattttgtattatttaatttatatatatttcaaaagcaatcaaaacaaattcatggtgatagaagtcagcatagttgttccccctggggaaaagtgattcaaagagacacaggatgagccgggtgcggtggctcatgcctgtaatcccagcactttgggaggccaaggtgggtggatcacctgaggttaggagttcgagaccagcctggccaacatggtgaaaccctgtctctactaaaaatacaaaaaattagcctggtgactcatgtctgtaatcccagctactagggatgctgaggcaggagaattgcttgaacccagaaggtggaggttgcagtgagccaggatcacaccactgcactccagcttgggggatgagtgaaaatctgactcaaaaaaacaaaaaaacaaaacgaaacaaaaaaaacagagacacaggatggctctgagatgctggcaatgttctgtgtgttatctgcatgctagtcacagtgatggcggtggcagcccttctggagcagcctctgcgggacaccagctgcagtgggggaggtgtggccggggctgcgtgctacacagagtcagccaggttgggaacaagtgggagccccaccccttaccaagttggcaggttgggagcccagtgctctgggaacagctgcagccacccagccacggctctggactcggcatccctgcggtctcagtggcccaggaagccgcccccctcaaccaacagacttggaattgcctcctcctgttccctggtgtttccctgctcccattgcctccaattttggagcaaagttgtggcagagccaaagtgctttggcaacctggccatgtatgtgtacgctcagggcagcgctgacacaccagccccctgccacctcagccccctctggactttgggtgtcaacaagcatgggagggaggctgaggggacgctgagggtggctcagcatgggcctgcaggtgcccctcagcaggaacagccttagtgctgtggatggcatgttgatggtggcaggaggcaggctcctgggtggaaaggcgtgggtccccagtgaaacccaacctttaagccagggacagactgaagcctggggaccaagctgccagctccaggtggagtctatggccaggagtgagaacttatggtgctttttctgggccgcccatggccatccatggaccaatcagcacgcatttcctcccttctgagcccataaaaaccctggactcagccagactcaaacagacattgagactaccagctgcttcataaattagttaataaaagctagtgagttttgaatgccacattagtagaatgaacactttttttttcttcaattatcttaagctcaggggtgcatgtgcaggatatgcaggtttgtgacataggtaaacgtgcaccatggtggtttgctgcacaggtggtcccatcacctaggtatgatgcccagcattcattagcggttcttcctgatgctctttctcccactcccaacaggtcccagtgtgtgttgtgcccccaccctccatgtttccatgtgttctcagcacagaatgggcgtttgaaggaagactttgaagaagaaaatgggaatgatttccagtaagtattttttatcagtctttttatgactcatacaaatatttgtgggcctaaagtaaatgtaaacactaatcttaagaaatatttgtcctttttgagttttaatgtgtctttatgtttgcatttatccaattaatatcagaacaaaaatatataataagtactagagacaatttaaagaaattaaactgtttccagaaggtagctaaataaatcattacttgtatttagaggcagaaaatagagaagtaaaatttaatgctaactttagttgatgtactgtgtcatataatatattgcaatttttagctaatttaaattaaaatagttatatcaatgattttgaaaccatgaagcaacaattatcataaatgttgttttttcaaaaattagatggttccagtagtttttgctacgtgaaatctctgactactacatcatctaaggcactttttacgtttcgtttataaagctcataaaataacctaaatgaaaaagataaatagtaaaaagcctgaagagctgatggagctatgtttcttgatttattcatctctattccatatctgaaaaaataatttatgacaatttctttgtatggaagaaaaattttataatgtttagatctattgggggaagaatgatttcctaggatttgaagctataagaataatggaaaaaaagatatatcattcttctatcttttatcatgtgtaaagtcgatttttaatatggcaagatattcaatctaaagccattaaagatatttccaaaaccttacaccagcttcagatatgttacctattatacaatgactttatttttaaaaagtaaggaaatattcatccttttactagtagtagatgattggacagctgtcttcattggtaatttaaatgtaattttgcctgaagtagatagaaaaactaatcacctcttggggtcttttacagtgatataattttatgccaactttcaacactagaaaagtaagcatattctttatgaaataaccagaatttatagctgaaaggaattttagaaatctagttcaggggtcagcaaactactgcccattgcctgtttttgtaaataagattttattgtaacagccattctcatgtttattcactcatttgttgaaatgttgtctatggctgccttggtcctacgatggcactgtggaccagttgcaaatgagaccatatggtctacaaagtaaaaatattccctagaacttgaagtataataaaaaaaaaaattatctagccctttacagaaagacctgttaatctctaatctagttcatccacctcttttacagatgaagaagttgaacccctgaggaataaagtaacttgcccatggttacatagacagtaaaagttagccgaagacacaggtcttttgctttcagattcagtaaaggtctcattacattatcccactactcataatgtaaaataatgtgtttgatattttctagtattcatgttatgatgaaataatcccttggtaagtaaaattttccatacaggcagtcagtctgcctctgttagccttattcttttcccttgaaattcagaggaaaattttaaaggtaagaaactgaaacacatattttggtccttatattgtcagtgtttctacataaggaaaacaatgtgactaaaacagatgacatctattattggatttccactcaataaaatgtttattttctctaatcaactccactttttttttctgcccattagtgttatccaagtaatacatcacgtaaggacaccattaagtagaatgcctgtctgtatctacagaaaatgagcagatggttggttcctcaaacatttaaaataaagacaaatgtagtcttgggtttaggggtgagacagtggcaggcaggacacttgggatgaaatgtataatgacgttgtactccacactccctgcatgtttacaatgtactatagatgtgaaagttaatgcaccataaaaaattgttataaaattttattttattttaagagcatgagttgggtctggtcactttcttgattgtgttaatggttttatgtgtttattcacatgacaaaatttaccagattttgtactttaaatacctgcagtttcttaggtgtcaatgacatctttaattgaaaaaaaggagtaacagaaaacaaaaacaatgagataaatgttttttttcttttttagcaagaaaagaaaatataagctagtcatttcagatacatgtatgtattgacatcaggtttgtttgtgacaaatcttcactctgtgacgaaaaagtacacattttcctgttggaccaaatctttgtttattcttgtagcttaactcaacataaagaacatgatttttatttcatatttttgtggtgataaatattttcatgcaaatgctttatatcagatggaagaacaaattactaaaacaaatacagttcatatccagtattatgtattcaccagaaactgttatattaatgattctagtttaatgcagagaaaatttcagttctgaagagtacttacgaagacacattttgtgcattaatgcaaaactgtagaaacatgaaaagtacagtgcaataaagaataacaagataacatgggtctagagtacatttttccaagtttgaagttaaataaaattatttctttcaagaacctaacttctactttaattaagataggaaagaagtcagacttacaattgtttgtttttgtattagcccaataaaaatcctagaaatgatgttctttatgtttctaaaataaggaagagtatcctggggaagaaaataacacttctttagttaagttgtatgttgtgtgcctagtgaaaatacccacgctttgttggtaatatcccaatttgccatcttctttccatatttgctctcaggggattagtgttgacttctaaggagttaaagctgctcttagaatcatcttttctaacccactgtagctgtctggaaaacagtaagatcccaagggattttacaaaatgtaattcttcaacatgcacaataaatgaaaagaataatttatatttcatacaactctaattatcatatggtaaaaggaaaaagaaaggtcatatccttgaagttacaaattatgtatacgacccatctgaagccatcactttcatacaaggtaggtttatggctcattaactctgttctgtgtaacatgagttatatgatcttactgtttatgcattttaaactatggatatattgattattatatatttctaaataactagtgtgtaaaattatgacaggaatgattggatgtatcttgggataaatatattaactagaattagtttcttctcaactattggaagaactaaaacaaaattcttaaacagaagtgattcaaatgatattgttattctaaaaatcaaaaaatcttttaaatattcaacaattacagcaagtgggacacaatatgtgttccatttttttcttgttttctgttttaaaatctgaaataacattttatgtatacctccaagagcccaggctgcagtgcagtggcaggatcttggctcactgcaacctccaccgcctaggttcaagcaattctcctgcctcagcctcacaaatagctgggattacaggtgcacgccaccatgcccagctaatttttgcatttttagtagaaacaggtttcaccatgttggccaggctgctctcagactcctgacctcaggtgattggcttgcctcgacctcccaaagtgctagcattacaggcgtgagccaacacgtctggcccaagaagaaattttaaagccttctcatgacagctattcgcctagaatttgacatgataaaacttttttattttaaaaaagagaaaatagaataattctccactcttgacttgtacatttgaatcaacattaagttgtcgtgggattatctttaaacaaaggtgatgggttttgtcatggggctgaggagtttcatttgctttattttattataaaatgaatagtataatattctaaactctacagaagattatacagtgaaaagttcaagtttccctctgcccttctctacccaatctttccctcctgaagtaaccacagttaacaactttttgtgtactgcttaggttattttctttctttcttttttttttttttttttttgaggtggggagagggacaggatctggctctgtcacccaggctggagcgcagtggcgcattcactgcaaccttcgcctccttggctctagcgatcctctcacctcagccttctgagtatttgggactacaggtgcgcaccaccacacctagctaatttttttgtatttttggtagagatgggatcttgctatgttgcctagcctggtctcaaactcctggggtctggccatccaccagcctccacctcccaggcaatccactcacctgagcctcccaaagtgatgggattacaggtgtgagccactgcacagagcagtgttcgggttattttctatgcgtatacatataggttttatagtgccaaggcttgtagagaataggtgacagccagtgatcaaagtggaatattttagaagaatagaaagcagtattcaattcaataaaacacttttattggacacctgctgtgtgcaaaaccacaataataaatttcacagaaggcataggaaagcactaggatgaagaagtcaccgtagttctgtcttcaattggtatgtgtttctgaaatgtgcaaacaccattactgcaaaaaaactcaagaatgttacgcagcattaaagactgtttgggagaaaaaaaacacagcaggattgactctactttgatgaatttttaatctcatcatatagtcatggaagactgacactgaatagcatatttgcagaagggaaatatcctagcatggtccaagtttaaactacatgaggttaagaaaatagctgggtaacattttggattttatccaacagacaaagtagtgacattaatggttattttaaaatagtctatcaatatcagatgtattttttttaatatatatccagttgaaaggagaatggatcagagatggaaaagaataagatgagcaaaacaggcacttagtgtgatcctccaggcaaggacccaacttaataggagccatagtaagactgaactcagagacatttcagcaaaggtgggactggcatggatgtggggtatgaacacttgaatttggggtatagaacagacaacttgggaagctacaggatttcttgtgtgagtgattgtgtagatgttgaagttgttagttaagaaagagaatatagaagaagtagctggtgcagagtgggaagaataataaacttggctttgcaaacactacatttggattgtctatgaggcctttccataaatcctcccagaagcaatgtgtgggacatttaagttcattgactgtgtggaacttggagccatacagttaaagattatttgctagagttagtatcactccacaagatttttatttttttatgtcaacctttattttggattcagggagtacatgtgcaggtttatggcatgggtgtgcctgggtgttcataggtggcaggcttggtgtacaaatgaccccatcacccaggtactgagcatagtacccaatatgtagttcttcaggctttgtcccccttcctccctctcccttcaaatagttcctagtgtctattgttgccatctctatatccttgagtacccaatgtttagctcccacttaaaagcaagaacatgtggtatttggttttctgttcctgcatgaattcacttaggataatggcctccagctgcatccatgttgctgcaaaagacatgattgcattcttttctgtgtctgcatagtattccatggtatatgcataccacattgtctttatctagtccaccactgatgggcacgtagcttgattccatgtctttgctattgcgaatagtgctgtgatgaacatgcaagggcatgtgtctttttggtagaacaatttgttttcttttggatatatacccagtaacggagttgctgggtcagatggtaggtctcttttaaattctttgagaaatctccaaactggtttctaagaggtaaacacatccacctagctgaaaatgctaaagtgggtggtaaaaagaggtggacacagaaggagagcacttcatcatggaagagaaatagcaccttgatctcaaacaggcacctcatcctcctgctggctcacagggctcagcaccactcccgctctggcattggtccaaagactcctttcgttactgtgctcctgggctgtagtgacgggtctgtctggcccactctttgttatcagcagccattcctccactcacattctcatcttactagattttagttagtttctctttcaccctcttgtccccaagagttagaatttattttgagtttaaagagtttttactactaaatacttcatgaaaaaggaaaagattttaaaaaatagaaacaataagaaagtgataagaattaaataaactcttaaatgtttttaccttagtattcatgttcatctttgaaatgtgaggaaaacacaatgagtggttcttagctatcttcattgcctcaagtcttgtattttccttctttgcatcaaaacttttaaaactttaatgattttttttatcccacaggctcttcccctgagtctttaccaaatcttctaaccatattctttcccagccattacactgggaagccctcaaatcaatctgaatgttgaacagcaactgcatgcacctgtaagactcatttataattcagagattatcacatgattatcacatgatcagtgtttttgctgcttaatggaggaaaatgctccgtgttattcttttttttttttttctgttgagacagagtctcgctctgtcgcccaggctggagtgcagtggtgccatctcggctcactgcaagctcggctcccaggttcacatcattctcctgcctcaacctcctgagtagctgggactacaggcgccgccaccacgcctgctaatttttttttgtattttttagtagaggcagggtttcagcagggtcttgatctcctgacctcgtgatccgcccgcctcggcctcccaaagtgctgggattacaggcgtgagccaccgcgcccggcctgttctgtgttattcttaacataattaaggacacaaagtggaatataagatatttttgtcttctccatgttttatttcagtttcaacaacaataaacatttactgactgcttcctggccagaacactggaaaataaaagaaagtgttacgtgtgtttttggttctcaaaaggcttactaaaggatagttatgtaaacactggaagagaacagataacctcagaagagagaattccctacataaccagttagcatatcctaaacaagatatcacacaattatgctattaaaagggatattttatatacgtactatataaaaatatgttttatatatttttatatattatatataatgcatatttatataaaataaacattattgaataattatttttatatttgggaggaaggtcaatttaaatccataccacattataacccaaaataattctatttaaaaatattttaaagactatttttccccaaatctcaaaggttctctttcttaggttctctttctttctttcttttttcaaaaaaattttaaggaaaaagccatgtacaagattttctttcttaaactgctaaaagcatcaatagatttgaggataatggcacacaagaatgttatgtttaaaaatcatccaagttagaaacataaacatgcattagttaaatgataaaaggatatgaacttgcagttgaaacaagaggtagtgaagttttaactaaatgttggctttaaaatgtggtaaaggaaccggtggagggagatggctgaaaagaagaccctactgaccatctccccagcaggaacaccaacctcaacatctacacaagaaaagcaccttcatagagcttaaaatcaggtgagcactcacagtgtctggtttaaacttctaatcgctgaaagaggcagcgaagcaggtaggaaagggtcttgaatcaccgaggccacccttcccccatcctccagcagcagctgcagggcatggagaatctacgcacttggggaaaggagagcgcagtgtcggtgagacatcacatgaacttagcgcttccctgtcaccgtggaaagcaaaaccaggctgaactcagctgacacctacccacagagggagcctttagactagcctgagccagaggggagttgcctgtcccagcagtcagaacttgagtctggcaagccttgccaccatgggctaaagggggagctccaaataaacttgaaaggcaatctaggccgcgaggcctgtgattcccggacaggtccttggacaggtcctagtgctaagctgggttcgaagccagtggacttaaaaggcatacaacctactaagacaccagccagggtggctaagggagtgcttgcgccattcccccaaccccaggcagcacagcttacagctctgaaagagatcctttcattccccttgcagagaggagagggtaaagaggactttgtcttgcatcttggataacagctcggccacagtaagatggacaggtacccaccagtcagggttgtgaggcctcctttctgggccctagctcctggaccacatttctagacacaccctgggacagaggggacccctctaccttgtagggaagaaccccattgtggcaggaaccattgcctgatgactaaagagcccttaggccatgcataaccagcagtgacacccaggtattattctgtgggccttgggtgagattctgagacttactggctccagatgagacccagcacattcccagcaggggtggctatggagctatggctccttctgcttgagaaaccagagagaaaactaaaggggactatatcttgcaccttaggtaccagcctggctacagaggggtagaataccaagtgagctcttgaggtcttcaattccagagcttggctcttgaatggcatttctggacctgccccgacccagaggggagcccactgctccgaagagtgagtgccaggcctgacagtgttcaccgcaagctgactgaagagccgtttggccttaagggaatatcagtagtagcccagaggtactcccatgggcctgtggtggtggcagccaccaggcgagtctcctctacctgtgctaaggggaaggaagagcgaggagggctacatctcatggtttaagggccaactcagctgaagtgtaatataacactaggtagatttctaaggtttttgactccagtccctggctcctggaaagcaccttttgaccctcctggggcctgggggcactcagtgtcctgaagcctggctggctttgccatctgcttatcacagagctctagggccttgagcaaacctaggtggtagccagatagtggttataggaagccttgggtgatacccagcactgtgctggtttcaggtctgactcagcagtctcagtggtggtggccacaggggtgctcgtgtcactccaccccccggtccaggcagctcactacagagagagagagaggctccatttgtttgtgagaaagtaaggaaagatagtgagattctctgcctgacaatccacagaattcttcttgaccttatccaagaccaacaagtcagctcagtcttactgagcttgggtgccctctaatgcagatacagcttagaccacaacatccaagtcttttcaaatacctgaaaagcgtttccaagaaggttgggtacaaataagcccagactgcaaagactacaataaatacctaactcttcaatgcccagacaccaacaaacattcaaaagcatcaagatcatccacagaaatatgaccttaccacattagctaaataagacaccagggaccaatcctgaagaaatacagatatctgacctttccaaaagacaattcaaaatggctgttttaaagaaactcaaagaaattcaagctaacacagagaaggaatttagaattgtatcagatagatttaacaaagagattgaaataattatatagaatcaagcagaaattctggagctgaacagtgcatctgacatactgaagaatgcataagagtgttttaatagcagaactgatcaacctgaagaaagaattagtgagcttgaagacaggttatttgaaaatacatggtaagaggagacaaaagaaaaatgaataaaagataatgaagcatgcctataggatctagaaaatatcctcaaaagggcaaatctaagggttattggccttaaggaggagggagaggtaggggtagaaagtttattgaaagggataataacacagaacttcccaaacctggagaaagatattaatatccaagtacaagaaggttatagaagacaaagcagatttaaccaaaagaagacaacctcaaggtatttaataatcaaactttaaaggtcaaggataaagaaaggattttaaaagcatcaagagaaaagaaacaaataatatacaatggagtttcaataagtctggcagcagacttttgaatagaaactttacaggccaggagagagtggcattacatatttaaagtgctaaaggaagaaaacttttatcctagaatagtatatctggtgaaaatatccttcagacatgaaggggaaataaagactttccactcaaacaaaagctgagggatttcatcaacaccagacttgtcctacaagaaatgctaaaggagtacttcatcagaaagaaaaggaaactaatgagcgataagaaatcatctgaaggtttagaactcactggtggtagtacacagagaaattgagaatattataacactgtaactgtgatgtgtaaattactcttatcctaaggagaaagactaaacaatcaaccaataaaaaataataactatgacaacttttcaatatatactaaacagtatatactatactatactatactatactatagtatagtatagtttcaatactatactaaacagtatagtaagatgtaaagagaaacaataaaaagtaaaaagcaaggggacaaagttaaggtgtagaatttatattagttttctctttgtttctttatttatgcaaacagtgctaagctgttttcagcttaaaataatgggttataagatagtatctgcaagtctcatggtaaccgcaaattgaaaaacataaaacaaatacacaaaaaatagaaatcaagaaattaaatcataccgccagagaaaatcaccttcactgaaaggaagacagcaaggaaataaaaaagaaagaagaccagaaataaccagaaagcaaataacaaaatggcaggataagtccttacttaggattaataacattgaatgtaaatagactaaactctccaattaaaagacacagagcctctgaatggatgaaaaagcaagactcaaccatctgttgcctaccaaacaacacgcttaacctataaagacacacatagatggccaggcatggtagctcatgcctgtaatcccagcactttgggaggccgaggcgggtggatcacctgaggtcaggagttcgagaccagcctggccaacatggtgaaaccctgtctccactaaaaatacaagaaaattagctgggcgtggtggtgggcacctattatcccagctacttgggaggctgaggcaagagaatcgcttgaactgggaggtggaggttgcagtgagctgagattgcaccactgccctccagcctgggtgacaagagtgacaccccatctcaaaagaaaaccaaaatgcaacaacaataacaacaacaaccaaaaacacacatagactgaaaatagatggatagaaaaagatattccatgtcaatggaaaccgaaaaagaggagtagttattctttttttttttttttttttttttgagatggagtctctctctgtcacccaggctggagtgcagtggtgcgatctcggctcactgcaagctctgcctcctgggttcatgccattctcctacctcagcctcccaagtagctgggactacaggcgcccgccaccacacgtggccaattttttgtatttttagtagagatgaggtttcaccatgttagccaggatggtctcaatctcctgaccttgtgatccacccacctcagcctcccaaagtgctgggattaaaggcatgagccaccgtgcccagccaaagaggagtagctcctcttagacaaaatagacttcaagacaaaacccgtaagaacagacaaagaaggtcattatataatgataacagagtctattcagcaagaagatataataattgtaaatacatatgcatcaaacagtggagcactcagttatataaagcaaatattattagagctaaagagagagtcagacttcagcacagtaatagctagagccttcaacaccctactttcagcaccgaacaaatctgccagagagaaaatcaacaaagaaacataggacgtaatctgcactatcaaataaatggacctagtagatatttacagaacatttcacccaatggctacagaatacatattcttttctttagcacatggatttttcttaaggatagaccatatgttaagtcacaaaacaagtcttaaaattttcagaaacattgaaataatatcaagcatcttctctgactccagtggaataaaattagaaattaataatgaggggaattttggaaattatataaacacatggaaattaaacaatatgctcccaaatgaccagttggaaaatgaagaaattaagaagaaaactgaaaaatgtcttgaaacaagtaataatggaaacacaatgtgccaaacctatggaatacagtgaaagtggtactaagagggaagtttatagccataagtgcctgcatgaaaaaagaagaaaaagttcaaataaacaacctaatgatgcatcttaaataactgtaaaaacaagagaaagtaatctgaaaattagtagaatttaaaaatgaagatcagagcagaaataaatgaagttgaaataaaacaattaagaagatcaataaaataaaaagttgcttttttaaaaagataaacaaaattggcaaagctttagccacactaagaaaaaggagaaggcccaaataaataaaatgagatgaaaaaggaaacttttaactgatactgcagaaatggaaaggatcaccagtggctactatgagcaactatataccaactaattggaaaatctaaatgaaattgacaaattcctagacagatgcaatctacaagattgaatcagaaagaaatctaaaacctgaacaaaacaataacaagtaataaaatcaaagtcataatagaaagtctccaagcaaagaaaagcccaggacctgattacctcactgctgaattctaccaaacatttaagtaactaataccaatcttactcaaaatattttgaaaaatagaggaggagggaatacttctaaactcattctatgaggccaaattgccctgatactaaaaccagacaaagacaccacaaaaaaagaaaactataaaccaatatcactgataaatattgaagcaaaaatcctcagcaaaatactagcaaactgaattcaacaacacattaagaagatcattcatcacgacctagtgggatttatcccagggatgcaagggtggtccaacataaggaaatcaatcaatgtgatacatcatatcaacagaatgaaggacaaaaagcatgggatcattttcattgatgctgaaaaagcatttgacaaaattcaacattccttcatgataaaaatttccagaaaactgggtatagaaggagcatacttctacataacaaaagccatgtatgacagacccacagctagtattatattgaatgggacaaaactgaaagcctttcctttaagatctggaacatgacagggatgcctactgttaccactgttattcaacatagtactggaagctctagctacataatcagacaagagaaaaagggcattcagattggaaaggaagaagtccaattatccttatttgcaaatgatatgatcttatatttgcagaaaactaaagactccattaaaaaacctattagaactaataaacaaactcagtaaagttgcaggatacacaatcaacatacaaaagccagtagcactttatatagaagcaaacaatctgaaaaagaaatcaagaaggtaatcccatttaaaatacctacaaataaaataaaatacttaggaattaatttaaccaaagcagtgaaagatctctacaatgaaaactataaaacattgatgcaagaaattaaagagaacacacaagaaatggaaagatgttccatgtttatgaattggaaaaatcaatactgttaaaatgtccatactacccaaagcaatctacagatttaatgcaatctctatcaaaataccattgacattcttcagagaaatggaaaaaaaaaatcctaaaatttatatggaacaacaaaagacccagaacagctaaagttatcctaagcaaaaagaacacaactggagaaatcacattacctgacttcaaattatattgcagagctatagtaaccaaaatagcatggcaccggcataaaagtcaacatacaaaccggtggaacagaatagagaacacagaaagaaacccacatatctacagtgaactcttttttgccatttcccaagaacatacactgggggaaaggacagtgtcttcaataaatggtgctgggaaaattagacatccacatacaaaagaatgagactagaaccctatctctcaccatatacaaacatcaaatcaaaatggattaaaaacttaaatctaaaacctcaaaccataaaactactaagagaaaacattggagaaactctccaggaccttgaacggggcaaatatttcttcagtaatattccataagcacaggcaaccaaagcaaaaatgggcaaatgggatcacatcaagttaaaatgcctctgtacagtaaaggaaacaatcaataaagtgaagagacaatccatagaatggaagaaggtgtttgcaaattactcatctgacaagggattaatagctagaatatataaaaagctaaaacaactctataggaaaacgtctaacactctgattaaaaatggggaaaagatttgaatagacattttaagacatacaaatggcaaacaggtatatggaaaggtgctcaacatattgatcatcagagaaatgcaaatcaaaactacaatgagatattatctaatctcagttaaaatggcttttatccaaaagacaggcaataacaaatgctagtgagaatgcagagaagagggaatcctcatacactgttggtgggaatgtaaattagtagaaccactatggaaaacagttttgaggatcataaaaaaactaaaaatagagctaccatatggtccaccaattccacacctaggtatatacccaaaagaaagaaaatcagtatatcaaagagatacctgcactcccacatttattgcagcactgttcacaatagccaagatttggaagcaacctaagtgtccgtcgatagatgagtggataaagaaaatgtggtacatgtatacaatggaatactactcagccgtaaagaagaatgagatctagtcatttgacaacatgagtggaaatggaggtcattatgttaagtgaaataccctaggcatagaaagacaaacatattctcacttatttgtgggagctaaaaattaaacgattaaattcatggagattgagagtagaaggatggttacagaggctgggaagggtagtgggggcggtggggaggaagtgaggatggtcagtgtgtccaaagaagaagttagaaggatgaataagacctagtatttgctagcaatatagggtgactatagtaaaaaataatttaattgtacatttaaaaatagttgagtataattggattgttcctaacacaaaagataaatgcttctcgtgatggatacaccatttaccctgctgtgattattactgattgcatggttgtatcaaaatatctcatgtaacccataaatatatacacttactatataacaacaaaaattaaaaataaaaacatttttaaaatgtgatacagtgtggaaactaaataaatatgaaaaattttagatggtaaaaccgcagtaaagtaggattgctttcacatattgttggtggcagcctaaatttttataaccattttagaaagcaatttggcaatataaggtaaaagtctctatattctttaaatcagtaaatgtagtgcagaacaagctaaaatatattctcaggaaataaattgtaaattatgattaactcaatatagcatccattaaaattataattttacgattctagaaatagtgtaaagttataagtggaaaatcatggatattaaattacatatacaaggtcattgctactaggtaaaattggtttgttcatttgaaatatgatatataaaatgtacaaaaatgttagcagtattttgaaagagtgattatacctgagtatttttgcaattattcaaattttgttattggttatatgtggtttttatgattttttttaaagaaaagtgctcctggttccagctaaatggacctggggtcattggttttctttcccctttgccttttcacttgataactctcaggttttctaacttgtctttttattttctccaggattaatttatctaaaatatgttgttaccaaggacagtgcattattaagttattgctgcaataatactgctgatcaaatcactctgatctcagtggtcgacactgaagaacattaatttttggagtgggggctccaagttctgcagaccaattagggcaactctaattgaggatgcaggttgccagggcttgactctggggtctaggctgcagggctgacccattcgtctcatttgggggctaaagctccatggaggtagctactgaggcatgctcttctcatatacctttgctgaatttctattggttggatgaagttatgggactaaagccaacatcaatgggaaggagaaatatatctcacccactctgtgattccacaaagtcacatggcagagggaaggagcaaagaattaacaataatacggtctaccataagtaggttaactgtcatctgtatatttcacaatctccatctataagtaaaagatgtttggttatataatctcatcagcgagttatttaacctaagcctcaatttcctccttaagtatggatgatgatagtatctgtttatggaatgcaatgggattaaattagataatgcttgcaaaacactcaacataatgttcaacatgctatctgttattaatcttcaagtctcatgcagctgtgtgagacatctatgatatttcacggtctacaataaactctagtataaatagagacacagggaaaagacaagaaaaatctctctccactttacttcacattctctatggggcctccaaaggctaatggagattcatttcaggtctctatgtcatctggatcaccccttgagggcttatgtataaacactgaggccaggtcatccttggttttcaggactctgcactattagagatggttttaagatgacttgagtaacaagtttgctctgtgcaagaactgagaatctaattcaagttaaggaagatttacaatctttacttaggttccaagtaaatctaactacctctaagaagttgcagtcgccaaagggattcagaatagtctctgagagttaagtacctctgggccacccagatctcgtgccctgggaagcaggataccctggcccatcaaactgacaaagtactcggccatgggatggtcacacctttgttatgttcagatttttttcttgtctattcaccttatattacctaaagatagcatagtcatcaacatataagccctataaagattaatattagacaaaattaaaattatcattaatgtaaaatttctaaaacattatcaatatattattttaatgcttgcccttcattttagcagaagtattgaggtaatttttctattctgcttacctttttgtggaaatgctgtgaagatacattgataaaaatattaagtattttattatgtgatgtcatgtgttattttgctttaaggagaccagtctcaacttctgatttcccataaaattattatgggaaatgtattaggtagcactgcttcttatatgtatggcatttattagaaactggtagcataaatcttaagaataaggaaaaaagagagaattaaaaagacagagagaaagaaagagagagaggaaagaaggaaggaaaagaaaagatgagggaaaggcaggaaataacttgccaaaaggaagcatgtttgaaactaatatagcaaggacattagactatgcgttattttgaatttagttatcaccttttctagttttctttatatttttatatgttcaatattaaacatccaccaaattccatttacctgcattatcaaagaattaaaaaagcatactttatcatgcacctagctctccttttgttcagttgaaactctggattaaactcattgaagagtctttgaaaatatgaaataatctgtttatttataacctttaattaaggaaatatccattaccatgtttccagttgacaagaataatgtcttggtcatttcgtgatttattattttttaagtacttttcagataacttgttcagaatagggtagaaaaagtcatgtatttgaatcatgtgtctcactctgcgattcaggtacaggcctaaaactcccggggctttcatcaacatcgcatttcacaggatgccacactaagccacatgcacagacacgctccatttgcttcttccattccagtgacatggtgcagttctcctgccttctgttaggctgggttctccgtggagtgctggcctgagtgaataccggaaagaagctactccctgaaaaacgcctttgtctccttcagggattccttctcgttacttggggtggcccccttgcatcttccctggaaagatcctgccggtcaggagccaggccttggtctgttgccgaccattctccttccctcttatctcaattctgataggcctttttctgttacccacatctttaccttctctccagccttcaatattgtatacctctctgagttctctcctagtgtattaaaaacactgagcttccctcacatgcacaaaacaaacaaaaaccctatttgctatcaggagcagcgattcctcattacaagaaatgtctgagttccacgaggcgtgatcttcttctgaatcttctggcctcgctcatgcaatcacctgcctcctctaaaaacctccttgcctttaaaactatgcatccccacacaagtttccaaagaacctttcttaaattcaaagtatttttctccttgttttataaaacgtcctcccaggttatgtgactttaacatcattaactaacttccctgtgccttgctaggtttcctcacataaagataaataataccttcctcataaagtaacagtgaggattaaataataatgtgtgaaaggtgctcagtacgactccagattctacggaaaagatcaaggaaagatggctattgttggcttttattgttaatacctcacagcccataggcttcaaaaccaatgctatcttatttgatattttaattatttgctgtttttggttatcttcttatttgattttttaattatttgctgtttttggtcatcttctttggtcatctttggactctcccaaaggtgacagtcctcccacgtgccagtgctcaagtcctactccaaaataagttggctttctctgaggcttaacacttcccagtccagagatataattcagcaaactactcaaacttgaaaataactttaaaatcccaccctaattcaagctgccaccatttctcatctggtgtcccaaagcttcctgactcatctccacatgtcacgctgctgcagcacatccaaacccactcctacacactgtgctgctggagaccgtcactgtgcatggaaaggtccaaatcccaactccctaacttcaccttcctgatttcacatgtcctgtcctctgcttacctccccactgtcccttcagccactcttcctttgtctttatcttctcttacctcacagtttctctcatctcctcccaattaccttttgccctttttaatcttcttttttaggaaaattcatacaatacaatgtaaactctaccaggatgtttttcctctcaaacttccctcctcccttcctgcttcctcagcctacctgaccgtaggtaacattcaaagtgcagctcaatggccaggcacggtcgctcatgcctgtaatcccagccctttgggaagcttaggctggtggatcacctgaggtcaggagttcaagaccagcctggccactatggagaaaccctgtctctactaaaaatacaaaaaaaaaaaaaaaaagctggatatggtggtggatgcacgtaatctcagctactcaggaggctgaggcaggagaatcgcttgaacccaggaggtagaggttgcagtgagccaagatcacgccattgcactccagcctgggtgacaagagtgagactccttctcaaaaaaaaaaaaaaaaggaaaaagtgcacctcaaggattgcttccttacaaaagacttcccttaaccctccaactaaatcagaagcctctgtaacatcctctcatccgtctagagatcatttctttcatgacccttctccagactttaccttttgtttatttatttgtttgattcttgcatatgctcgcttgtccttgctagaacatatatgttcagtgagggaaggatcctttctgccttgtttattgctgtatctcagaatctagaagaatggggcatagaatagtaaagtttctatttaaaaaagagcaagaattgcacgtcctttaaaatattttcaataaatatttttaaaaagtcatttaatgaatttcattgaattgtgttcatgggacaattaaattgtctccctcacttgacagtaattccaaaggcttatggaaaccttctgctggtcgactgttgcaggtggagcctacacagtgcacggcgcgacggttggggctcctttaatattagatcaatcaacatgcatctttagggtgcccccactgtgcctgcgtgagaacgtgaaacgttactgcttcctcagccttctttcttccacacctctgagtggcaccctgaggaggaagtgctcatgacttccgtagtgaaggctgttctctctgaagatgtcactggggaaattttatcctttctaaatttagaaagtgggggagagaaatgcagctaaatggttcagattcagagggagatagtgagaaccctgaaaatgaatcatggtacttttcacacacatagtgaatcaaaatttaatggcagtgaaaggctgttgataacattcctttaaaaaatccacataaccaaagacatttacttgcagaaaacttcctggacttctaagtagaatactaggcaggtctgtatttttaaatttagaaaccagtcacagattttttttctctaaacttcattaagagctgtgctctgtatcagctggtaagcctctaatcctacaaaggttgcttatcaggtttggggaaaaaatattttaaagggaatacaattcttgctctttcttaaatagaaattttactattctatattacattgtcgtataacatgtcatttggtgcccctggaatctcctgtaaaatagaagcgtacgctagtaaatgtcatgatgaaatgaaaccagggattatgaaagttgtgaagctttcattaaatataaaatcttatattcggtaccttagaatcagtgactctaatacgttatttttaaaatttattgtcaatattagccgtgtccccaaattaagaaactgcactgagcgtttacggcattgacttaagagaaatacagtcaacgtattttaaatatattaccatctgtacccaaatataaaatgatctttaaatgtaaggtagttccccattttatcacaaactgttttgatcaacttgaaatagaagcccttaaatgaaagtgtcaaatgtcaatttacaatattaatcatttcagttacccagacatttaaaattacatattctggtacagcactgtttagggaactttctgtgatgacagaaatgttccacatttactctaatacgggagccaccggtcacatacggctagtgggcatgtgtgcccacttgaaacacggctagtacaaccgaggaactgaatttgtaaattaatttaatcttaactaatttaagtttaaattggttggtgtggctagtggctactgaaccagataacacagctctagaaaactaaagatttttttagaaatgttgctattttctactctcattcaaactccacacgcttcattgacaacactattgtcatcatcataacaatgatgttagatatgttatttaatttttcacagcacataatttttacttctaagttgattgaaaatacaaaaaaaattagaaaaatgttatgtgaaaaggaatatagaataagaaaaatgtgccctgatactcatggggccagattagcccttgtgtaaaaagagtttgaggagaggaggcacaaatcaagagatccgggccctgttctctttgaagaagattctacttagatgttcgggtttagcactttgttcttctaagttctcagaaaccaaagaatttgtgtagaaatggtaattttacctgatgtattacccaagaggcctcttaaggacaagggtagccctcttttatgaaggcaatttttgagaaaaaaagccattgctttatatatggtacatatggtaagtaagaacaattgaagaagaactgaacaccacttatttaaaaattgtgtactttatttacaaccacatgaaatattttccaatcaccaagccatctttagaagttttccttccttaatcatcaaaatgtcagtacaagaagtttggatttagttgtgagtgactgggtgctgtaaagtccaccaagtagtggcatcatagagcaccaggtggctccctaaacagtgagacctgggcacaggtgtcaatccccagagattctgtcatctaagtcatgaggtcatctaagtcatgagcatccacatggaacatacagctatgcagttactggcaaataaaacaaaataccgactgtgtctcctacagtgagatcaaagaaccactctccacttactctgcaaacttgccttggtaccatctccttccgagattcaataattgatgtttaatatgtgctatttagttctgctttattattaagaattccttgaatgagatgaatgaaaagaatattaatctacttcaatctagaaaaaaaaatcctcatatccataaaatgaaattaatgatttccagaagcaaataatttctgtgatgatgttctcagaagaattaaggtgctatctggtgccctgcttggatcgttagcctaatgggactgatcaatcagaaggataatggctagatggatatttttgttgttttatttttaatgaataagagatacttatattcattaaaattagaaaaaagataatgaatcacctcaaattacagaatttccatatttcccaaaaaactgacagtgtgtctgccaataatagccacatacaatatttatgcaagcctggctttctgtaatgagaaattcaacaattgccatggtgatatcttgggaggcaaggaggaaatactggtgataacgggagtcttgagtggtgatggcgggcagcatcataccatcccccttgggcctgggatgctgccaaggtctgcagcgtgatgtttgtcctcctccatcgtcatccaaacaaacaggaaacttgctctacagaaagtaattcttgctgtttttctttatacatttctcaaaatatcttttaaatactttgttacagtaggtagtcaggcctacatgagcagggcaagagagcccttccatcccaacagaaatgtcaggttaccattagatgatggtcaggcagttgttaaactgtctctctaaaaaaataattggttacagccagtgccgtggaaaggcagtctcccagcagatagaaacacctgaaactggtgatcagcttcccagtaaggtctcaggagttgcgcaagtgggctcaagcatgcgcattaagaggcaaaatggcggagtttaactggtagatgaccttgcacggacatttgactggtacgggaagaacgcttcaaatgagcatacatacagctccggtaaacacactgcacgtgtggcacctccaagagcgggcaggcaactgcacaggcagacagcccaccccaagggcagaatcagggaagaagagacgcaggaccccggaagcatgccaacgtcacaccgcgcacttcatccctcaagtcacccgcgtggccctcttgcgagtgagctttgcttcctttcgttcctgctctgaagctttttaatgaactttcactcctgctccaaaacttgcctcggtttctgtgtcttacgcgcctcagtcgtattctttcttctgaggaggctagggctgaggttgccgcagacctgccccgattcgccgctgctaagaatttctcagactccaagtttccagtcttccctgagcagctctctgtgacttttttcttcctgcgctgtctcgcactttacacacagttttctctgaggaaccttcctcctactaaatgttctaagttagttttccatgattttttttctcctccttcttcccttgactgttgggatacagaaatatttcacacaaatgatttctaatacgattgagtaggaaggaaatcagcttactttaaaagtctagaagcattcttaagtctgcttttcaataatcgtcttttttcatataatacttttcttgccctctttggaaactttgagcctgaatacaaattagaacaacacaaaattcaagtccttatgatggaattcaaatttgtattttggctcaattagctgctttctagtacatttaggatcatagcatttagcccacatttagtggcaaaggtagtaacattaacgttgggttaagtacaaaacattaaccaaaaaatcttgtagagaattgagatgttatgactagaaagaaattatgaagatgttattttcagggtatacatggactttaactgggcactgatttttatcaagaagtattagcaattaaattaactgtctttcatgtgtttaagaaatcagtcttctatccatattatatgagacaagaacatgacaaaatattttaaaaagcaaaagaatgattataaaaaataatgcagaaataatatttttaaagaaaatatatttaaaatgcagttttgggatattttacagcaagttacttcaaccatacctctagttatacagaattttgtcaagaaacaaatcatattttaacatatctagtttgaagttttccaaatacaaataaataaggcatcttaaaagcatgacaatttattctgtcattacttaaagcttttaattttgcatacttagggctagtaaagatataataagaaatagattggaagcagctgaacaaacatagtgttcataaatgcatttgatttgatattgacgtcaagcagttctaccaaagtgatttaagaacttgagagataagctaatacggtggtctaaagggagtcttatcttgttctgtacatatgagttcagagctctctattgaattctactttttaccacatctgattattcttcacggaccactgggaatagaccaaattggggccactgatcctaatttaagtcctttctgacccctttctgagtcttcaattcttgcttgcaaaagagagtattcaaaatgtccgtatcaaaataatatttagataaaaggtgtgaataattcatgataaaaaatttgctttctgattatgtaggttattatattaactaaacatgtttattttaccttttgatgtggctctgttctgttagccctaccacaaagatgatatttgtcacagtgtaacagtctattatattacctcttacaaaggcatgatattctattgatgtttaatagaataatttttaaagtacaaataaatgatttaatttatttaaataatttatattaaatattaaaatgtatatatatcacagatattttatatgtatattacctatattcaggcatgcagttagggaaagaaacggagggaaattgttagttaaacatgatcttaagaatttcttccatatgtggaaaagtcatcagttcatctggcatatagcaatatatacatatatatatacatatatatagaatgctatgtatacatttatcctacattcatttaacatcaaaacataaaaaagttatttctttattctctctaagcaaaaaccagtaataacagctctgtaaatagactctagaccaacagatcaagggaacaggttaaaccccttgcttatttgttagaattcaaagagcctcactttagctaatctgattgggctaatttgtgtgtaaatacagatatggatagatagaactatatatatatatacaaacaatatatattttatgtaatataaaatacatataatagataaattagaatctattcatttaacttacctgaaaccatataatcactcaaatgtgtctgcatgtctgtgtgtatctgtgtatgcatgtgtatgaaatgtagttttttaacttgacatataatagatgtaaatattttcggggtacatgcgataatgtgttacattcgtataatcaaataaggataattggaatatccatcatcttaaatattcatctttatgttagaaacactaaagttattatcttctagctgttttgaagtgtacaatagattaatgttaactatagctatcctactgatacatcaaatactaggtcttatttcttctgttataatgcatattcgtacccattaatcaacctctctttagctcccctttcccccaacccttggtagcctctggtaatcaccaatctactttttatcttcatgatatctttttagctcccacatatgagtgacagcattcaatatttgtcttgctgtgcttggcttatttcacttaacataatggcatccagttctattcatgttactgcaaatgacagaacttcattctgttttatggatgaataatactccattgtgtgtgtgtgtgtgtgtgtgtgtgtgtgtatcacattttctttatccattcatccaatgatggacacttaggttgattccatatcttggctattgtgaatagtggtgcagtaaatacaggagtgcagatgtctcttcgatatactaatttcctttcttttgagtatatacccagtagtggcattgctggatcatatggtagttctatttttagtttgtttaggaacctccatactgttctccatagtggtgttattaatttacatttccacgaacagcatatgggggttcccctttctccacatcctcaccaacatttattattacctgtctttttgataaaagttattttagctagagtaactccttgtagttttgatttgcaattctctgacggtgagtgatgttgagtattttttcatatacctgttgatcatttgcatgtcttgttttaagaaatgtctattcagatcttttgcccattttaaaaatcagattatttattttcttgctattgagttgtttgagctcctatattctggttattaattcctgtcagattgatagtttgtaaatattttctcccactctgtgggttgtctcttcgctttttttattgtttcctttgccgtgcagaagtttttagcttaatgttatctgatttgtctatttttgctttggttgcctgtgttttttgaaatcttacacacaaagtatttttccagacctatgttctgtagcatttccccatgtttttctcagtagttatatggtttcagatattaaatttaagtcttcaatccattttaatttgatttttgcatatggcaagggctaagagtctagtttcgttcttctgcgtatggatatccagttttcccaggtccgtttattgaaaagactcatctttccccattgtgtcttcttggcaccattgtcaaaaatgggttggctgtaaatatgtggatttatatttgggttctctattctgttctgttgatctatatgtctgcttttatgccagtattacactgatttggttactacaactttgtggtatattttgaagtcaaattgtgtgatgccttcagtttcgttcttttgtagttccatataaattttaggatagttttttctagttttttgaagagtgtcattggtattttcatgggggttccattgaatctacattttagggtagtgttgtcattttatcaatactaattctttcagtgcaaaagcatgacatatcctttcattattttgtgtcctctgcagtgtcttttatcagcgtttgatagttttccttgtacagatctttcatatctttggttaagttgattcctaggtattttatattcttcttagctattgtaaatgggattagtttcttgatttcttttctagattgtttgctgttgccacatctaaatgctacttattttggaatgctgatttttatatcctgcaacttgtaatggagttttggtggttatgactatgcatgtctttgaactgatttggtagttgaaagacatatatttttaaaacttcaaaaattagagaattgatatgggtagatatttaaactctacttcattaattcatctcattttatgaatgtgataagatactagaaagcaagtggcttccaaggggcaaaaactaataaattacagagacaagactttagcctaacttgtttaacttacaataaagtggtacttctctacctcacttagaataaagcagtattgtatctcctccaaagtctgtggtgaaacttaattctcagcacaactgtatcaaaaggctggcccttaggaaataatcagaccatgaggcctctgccctcatgaagaaagggctggagagaactaactagccctcttttgtacttttttgcctttccctcccttctggcatgtgaatatacagtgtttgctcctctggagaatgcaacatataaggcgccatcctgggagcaaagacagggccctcactagaccctgaacctgccagccccttgatcttggacttctctgttttcagaactatgagaaatcaatttccattgtttataaattactcactctgtggtatttttttataacaacacaaaaaaactaagacaaattggtaccaccagaaatgggtgttgctataaaaatacctcaaaatgtgaaagtgcctttgaaactgagtaatgggtagagcctggaagaatttggaggtgcatgctagaaaaagattagattgccatgaacagtgcattaagggtgattctgatgggagttcagaagagaagagctgtagacagagcctcaatcttcttagatattacatacatggtcatggtgagaatgctggtagaaatatggacagtaaggctattcttagttctcttatttggagatgaggaatgtcttatgggaaactggaagaaaagcatcctagttataaatggcaaagaacatggctgaattgtgtctgtgtcctagtgttttatgaaaggcacaacttagaagtgataagctgggacatttcgtgaacgaaatatctaacaaagcattgaggttgtcgtatagcttctcttgactgcttatagtaaagtgcaagaaaagagaaacctgaaatatgatcagagctgaaatctataatcaaaagggaaacagaacttaaagatttgaaaattttgggcacagccagatggtaaaaaataaaaaagcatgtttgggagaaaacaccaagggtgtggctaagggagcatttggtaaagaggttggtatgggtagaagaaggccaggcactattcatcagaacaatgaaataatcaccccaaagcatttctgaattctttgtggctgccctactcatcataggcccagcatgccagggccttgagggttgaactgtttcgaaagaagggcccagtgtggccttactgactgggattgcctcaagtctatgttccttgcatttcagtgcagtgctccttggtcaccccagcgtggctcaagtgggcccaggtgtggctcaggctgttgcctcagagggcacaagcagtgaatggtgacatctccatggtgctaagtctacaagcacacagattgcaagagccatggaggcatggatacctctacctagatttcaaagaatggctcagacagctgtggggcccagtgttttaaacttcaaaggctacagtttaaaacactacactcacaggcaggcccactgcagacagccccccatgagggcaatgcccagcacagccatagagtcaaggccaccatagagagctcccattagggcaatgtctggtggagctgtggggatggggtcatctccaagacaccataactgtagaggcaccagtaaagcaacgccagcctgcgagagctgcaggcacctgactccatcccctgaaagctgctgtgtgggctacaccaagcaaatcagtggaggtggggtcccccagtgacttggaggtccaaactctgttctaatgtgtccagcgggcagggcatagagtcaaagattgaatattgtttgacttgttgcattttggacttgcttaggattgtgttttgggagcatacaactgtttaatgttacaggctcacagttgaagagcaaattgagtctcacccatatctgatctagttgagatttgaatttagactttaaggttgaatctggcatgagttaagactttggggttattgggatgaaattcatgtgttttttacataagaaggacacaaatttgaggggagggtcaagagcagaatgcaacaggttaaatgtttgtgtctcctctaaaattcatatcaaaacttaatccccaaagcaactatattaagaattaggtcctttaggaggtgattaacctaagagggctccactctcatgaattagtgacctcatacaaaagctgaagataactagctaggcctatttttgcctttttgccttttgccttttgccttgtgagtacacagcactggaggtgccatcctcgaaacagaaaccaggaccaaaccaaacaccaaacctgctggtgccttgaacttgaacttcccagcctccagaacagtgagaaataaatttctgttgcttagaagttatccagtccaggtatttcattatagtagaacaaatggattaagacacactgtaatgcactgcttcataaatggcattatattatcctattaattttgttgttaattttgctctttaaagaaatgataaaattggggccaggctcagtggctcacgcctgtaatcccagcactttggaaggccaaggcgggtggatcatgaagtcaggagattgagaccatcctagctaacacggtgaaactccatctctactaaaaatataaaaaattagctgggcgtggtggcacacgcttgtagtcccagctactcaggaagctgaggcaggagaatcgcttgaacctgggaggtggaggttgcagtgagccgagatcgcaccactgcactccagcctcagcgacagagtctcaaaaaaaaaaaaaagataaaattagtaggaaaaatcattttaatgaacatgtgatcttggaaatttgctctgaagccctcatatggcagcaatattaaagcagattaaatactaagatacgtgtgtgcgtctgaaattatttttacataaactggtttctctaactttactcaagattattttaactaattttaggcagagtaataccctagtttgaaaatatttttaggcaaggaaattgcaagcccccgtttggcaatatgctctaacacagggcttctcaaccctcactatccatgaacccccagctaaaccacaacatgcatgagcacacacacacacacacacacacatgcacatacaagtcctccaaatcaacatgagaaaagtctctcacataattcaagaatgctgtttcaccaacttcaaccctcagtctgacaacaagatgtaatagtaaatgtagtatatccgtttgaagcactttataaactgaaagaaactggacacaaataaaatggttcaaccatctcttcgataatttttatagccatggaaagacacctcatagtcacataatcttaagcgtgttcatggagcagcgagtcaaatgacattatgtggcaataaagaagacttcagcgcgtttcctgactttaccagtgaaaacatctgaccttgaggagggcactgaaaatgccactgcatcgacattttttttttttttagatggagttttgctcttgttgcgcaggctggagtgcaatggcacgatctaggctcgctgcaacctccaccttccgggttcaagcaattctcccgcctcagcctccgaagtagctgggattacaggcatgcgccaccacacctggttaattttttgtatttagtggagacagggtttcaccatgttggtcaggctagtctcaatctcctgacaggtaatccacccgccttggcctcccaaagtgctgggattacaggcgtgagccacagcgcccggccgcatcgcatctatttttgtaaaatatgcataattctagaatatgtttgttgtgaggattgaagctcataatatgtacccttttaaaactttatgttgaaatgcctcaaatcaaaatattatcatatgatgcagtttattcatccttatgagaagacacctgatagggactgtcaagggtgactgtatcaaatgtgcaagagattcggggcatttgcttattgcagtgaattgcacaaaagaattatttgaaataaatataacatgcaatgaagttgtcaataagtagcataatttatacttgctagttcaatgctggacacagataaagtgtttcaaaatacaaatgcctcacagagaaaagggaagtgaatgagaagaaaggaaatttattgaaatgaaagataggagaaaacaggagaagcacagaagtgacagacaggaacctattgcacatgagaatgacacttcactagacagaccctttcagaattcaatcacaatgctaaactttccaaaagttcacaaagtaaaacttttgagtactagcagtgacacaggtcctgttgaaattttcacaggaaatagagggaacataaactgattagtttttaatcaagataaacacatatgtccactctaacttagtaatcgcttatgtttaacatgttaaatacaatgtattaaacttattatatgctaggcactgttttaagtgtttaatatctgtggtctcatttattgctgctaactgcctaagaaaataggtaatatccctactttagctttgtggaaacagatgttcaaagctattagtctcccatcatagcaagtagctgagccaagatgcacacgtggtccctacagtttaaaacactacactcacttttctcttctgtactattgaagtgatgctgtcattattcactattcatttaatgtcttttgcacttgttttaagatcagttcaggagtatttcagttcaagtcccaccatgaaaagagaagccacaccagcattttagtagagagaattgtttccaaggttattgtagacccgaaaaggcaaaaagggagacagaggatggttagcttacatctccaggactggaacaaaggaaaaagaatgggcttatcaccacctacaacctcagaaactaggcccagcagagctgtgacccagacacctgagaagtgggcttttctttggaggagtcagggagagaccccacagagctgggattcagatttctgaggggcggtgctacctcattgctgcttgttatctccaagctggagatgataggaatggttctgggagtgtggaagaaaaggtatgtcaactactaaaccgaatgctgccgtggctgtattgacttgagtgcttcccttctctccgcctgctgtcttcctgtctcccactagtgacttgtagctgcagaagcagacggcaaacagtcctacagtttccaacccagcaccactgagcagatatataaaggtagatttgagctatgcaagtcagtcagttccattattttataattaagccatactttttgtttaattactatatactcaatttatcagatttgattaaataacctctgagtattgtcaaaagataaatccacttcccaaagataaggatttgccaccatggaggatatcccaatttcagactacatctattttccaggcaaagtttcaaattattttcctcaggagacatcaaaagatgtcttcagagaaaagacctgctgatactggcgttaggggttacataaagaaaagggccagctccttcctgagttccctggagtgagttccagaaaacaacccagagtttccaatcagcgtcttagtgtccaaggaccagccgataatgtgagaaaatatcccatgatgaaagagtaagtcagtaataaagcaaaatgtggggacagaaagataattcaggaagtagaaaactgaaaaaatgagtataaattatcagaaaaataaaaacaaactattgataacaacaggaatgccatgaaaaatgaacaattagaaaacagtgacaactagaacaataaaaaagtctttgaaaattaaaaaaaaaatgatggtcaaaataaaacttctaatacaagaggaaaagtttcagaaatctatcaaaaaataacaaggaaaaatacaagacatggagaatcattgcaagaaactcactttctagaaaaaatggcatgagagtggggagacagaaaaaaacgctggagaaaaagttataaaagcactaatacaggaaaatttccccaaactaaaagacttgagtcctcaaaatcctttttaatggccaggatgaaaaatgaaaatgtcttatttaaggcatataaaattaaaaagcatcagcactaaagagaagcatctaaaattttccataaaaaccgtaaatcacatacaaaagaatgagaatctgaatagtgctgaaggatcaacagaagcctttttttttttttttttttttttttttttttttgctaaaagtcaatggaacaacaaggcctgataaattttaaagaaaaaataatgttcaaccttgaaattttgttaatactttattctacaggtgtactgcttttaatacacacttcctttaaaaatttccttgctacggcaaggaaaacagaaagtaactaagaaaacgggagtcagttctagaatatggtatatccaagttaggaaattaggaacacagccacagataacagcacacagctaaagccgagagcagccagtccagatcacagcaagtgaaaagagactccaaaaagttttttctagttaagagaaagactcagtagaaaagtagttgatatttagaatcatagccaagaagaattaagaagagtaagtaagaaaagaattaaggatgtgagaatgaattatacaagtgaaagaacaggtgcatctccttcaaaacaaatatctacacagtataaaaggagtaaacatagcatgctagctggcccagcagtgaacaatattttcatcacgtagtggtgtaaatacagcttgctaatctacattaaaaataatatgattctattgtgataattctattgcaagaacgagggaggggcaaataagagaactaagtctatatccatcatcatagaaaatcaatatgtaatatttcaacatgcaaaatcaataaatagcaatatagatttcatgtttagaaatagggataaaactacagaagaaaaagctgaaagagtgaagtgtctgcctctgtagggtggtactacaagaaaaaagaactgcaaggtgctattgtgtactgtggtaagttttcagtatggggctgtttatttatatgtttgatctaaaaatcgtccccccccctccgtggctctgccctgcgtgggcggactgcgaggacctgatctctgcaaactacacttcccaggattccttgtgcattgactgctggctcgtttcagccaatgagaggcactggcagaaagtcagttgtcctggtatatgctggcatatctccgcttctctctcttctgtggtgccacctctggccactgatattctcctcacaaggcacaaggtccccctgcctagtgaggcctccaaagttctacttcaggcttggcggctccaactcttaagctactctctttgaacctccaacctagggacaagggcaacttccagcagcaaggaatctcatcttccgctggtggctccttaaggtcttataacacctttaaaaatagcgtcctaggccgggcacggtggctcatgcctgtaatcccagcactttgggaggccgaggtggacggatcacgaggtcaggagttcgagaccaccctggccaggatggtgaaaccccatctctactaaaaatacaaaaattagctgggcgtggtggcgggcacctataatcctagctacttgggaggctgaggcaagagaatcgtttgaacccgagaggcggagcttgcagtgagccgagatcctgccactgcactccagcctgggcgacagagcgagactccgtctaaaaaaaaagaaaaagaaaaagtgtcctatattaaataaattcctcatattttatactaatattaattccaattcaatactttacatcagctttgatttttcaaatggccctgagtgatacaagtaactgtgtagtattttaatatacaagtgtcagaaagtattgacagagcctctcgaccaaactttactctcttcaacgatttctcaacttttagactttttttacttatctctacattgtccaaatttagcaagaagcttgctaagtcaatttagtcattctccttgtctgctcaccctggatatctgatcgggttcctcatcctccaccatcctccagatgatgtgtgattgccctggcctgcctccagccagcatcctggcaggtcagtttggccacagaatctcccttactactaatgtttcctcttagtaattttccgtccaccgagctccctcccctgctccttgtttataaattctcactttttcttatttttttcagaactgagcccaatctctctcccccactgcaaggcgccattgcagtagtcctggatctatgacaaaagtaccctcttgaacaaagtctcccttactgtttttaacaagtttcattaatacttttttcttaaacagtataagtttctaaaaggtcaaatatatatttcatagtgctttgtgaattcttaaggaaaaaaatcagaacaatggcagaatcacttcaaaagaaaaggcgtggtggctcgcgcctgtaatcccagcactttgggaggccgaggcagcaggatcatctgaggtcaggagttcaagaccagcctggccaacatggtgaaaccccatctctactaaaaatacaaaaattagctgggcatagtggcgcatgtctgtaatcccagctactcgtgagactaagcggggagaatcgcttgaacccgggaggcagaggttgcagtgagccgacattgtgccgttgcactccagcctgtgcgatggagcaagactctgtctcaaaaaaaaaaaaaaaaaaaaccaaaaaaaaaaaaccaaaaaaaaaaaaaacagagagagagtgagagagagatcttatattctcctaaagtgtctacttggaatgaaattctcaggagttcacttatggctagttaaagccattgcattgttctacaatactgcaaaatgaaataagtaaaatattttgtccccaaataaaagagtacagcttactttttctaagaattaatattcatgaaaactacacttgtgtttttattttgtccccagtgaaaatcagcgtctcagcagcagatccactgaatatatcggtacaacttgatagatcactgcttcttcctacgagacttcagcgtcaaactaaagggaaaaacccagcagttttcttattattatcatgtatttaattacataaataatatttttaaaacagtccagaagagcacataatgaaaaccatgtctctctcattcgagtgtgctctctgtgggcagccagtgtccacgtctcctgtacccttccataatccatttatgtagttataagcatgcatttacattttcccagaaaacggggataataacatcattaactgaagtaaaatttttgtaaggattaaataagaagagaaggaaacaaaaatttaatatattaagtccttaataaatgataaatatcagttattcatattttctaatttcatcaaactatctactatcaagtatggaaataaatttatctggtctcctactgaggttgttttccaagcttccaagtttccaaagtttatataagtataagtattgtataagtattataagtgtatgaaatgcatgtataaaaaatacatagtgttgttgtagatttaagggattgtgcatttttacttttgtattaccaaacaatcctccaatcaaaaagcagacacacgcacacactatataagaggtgtgataatgatgtatagattgtaagtgtaatataagtcttcaaaatatgtcttgtggaacagatacaatctttcacaggtaaaaactgaatctttagtaggtttaaaaaagacattgtatatcgacataatcatgtgtgttataacataagcagtgatgtgaagcaggaattggatttgtatattgactccctgtcacagttaagatgctagactagttgaaggggaagaagacgaggtgtatcaactgaagtcagattatagaggaagttggagccaaatttctgagttgttggagaaggtaattacagattttgaaaccctggaagatataaatgcaattttttgtaaggacaatcatacctcctcttctcagactgatgatttccattacattttaaagggcctaagcaacaacatgtttttggtaagtctgagcatagttgcaaaccaaccagttcctaaattatgaaaattgtcattttctttcaaagcaaaatgacttaaacggctacaaatcaagttgtattgaataatccagggtttgcaatgtttactgtaattctgttttctgcaatgtgtagttttaatggttcttttattttgagaattagttctattggtatcaatatactcttagctcaagcagtaggtttgcttttttatgatactgtacaacaacttgagtggagctagcaggctgatttcatatgctagacatatctacctatccagtacttcttggcatataattttttttggacatgtacaaagtgtttttttccaagtatacaatacttcaggattaactatagtggatatgctgtacaatagatctccagaactcattcatcctaactgaaacttggtacccttcgaccaacatctatctcctcattctcctcccccacatcctggcgaccaccgttctactcttggcttctatgagttcaacttctttagattacatgtagacgtgagatcatgcagtatttgtctttctgtgtttgacttatttcattagcataatgcttatccatattatctcaaatgacaggatttcctttcttttttttactctaaatagtattccattgtgtatatataccacattttaaaaaatcagtttatctgttgatgagcatatcttggctattgtgaatagtgctgtaatgacatgggagtccaggtatctctttgacttactgatttttttcctcttggaatttatacccaatagtggaattgctggatcatatggtagttctatttttaacttgttgagaaaccttcatactgttttctataatgactgtgctagtttacattcccaccaacagtatagaaaggttctcttttctacatcctccccaacatttgttatcttttatcttttcataatatctatttgaacaggtatgaggtgatatctcattgtggggttactttgagtttccctgattattaatgatgttaagcaattttttcatataccttttggccatttatgtcttcttttgagtattgtatatgcaggtcctttgccaattttttaattggattacttgttttctggctatttggttgtctgagttccttatatattttggatggtaactccttatgaaatgtatgctttgcaaataattccataggttgtttttcacttttgatcatttcttttgctatcagaagcttttattttttaacattatttatttattttaattgagaaatattgtatttatcatgttttaaaatgtgcatccattgtgaaatagctaaatgaaggtaactaagatatgcattacctcacatacctatttttctgtgtgtgatgagaacacaaaatctgctcttaacaattttcaggaatacaatatagtcatccctcagtgtagttgggagatttggttccagaagccctgcttataccaaaatctagggatactcaggttccacagtctgccctgtggaacccacatatgggaaaagtcagccctcagtgtatctgggttttgcatcccatgaacactgtatttctggattgaaaattctgtattttcaatacagaattctgcagatgcagaacccttggatacaaacggctggctgtatttattgaaaagatctgcatagaaatggactcaaagaattcaaaccagtgttgttctagagtcagctgtacattgttactaactatagtcaccatgttttacattaatgctcttcaacttatttgtcctatcttactgaaattttgtatcctttgcccaacatctccccagacctccatgtttagcccctggtaaccactattccactctctgcttctatgagttccatattttcagattccacatataggtgtaatcgtttatatttttgtgcttggcttatgttacttactataatgtcctcctccagattcatccaggttattgcaaatgacatgattttcttatttttaaagctaaataatagtccattgcatttatgtaccacattttctttatctgttcatctgtgatgtacacttaggttgcttccatatctaggctattgtgaataattctacaataaacatgaaaatgcagatatctctttgacatactgatatcattttctttggatagatatccagtagtaagattgctgggccttatgatagttctatttgtaattttttgtgaaacatccatactattttctataatgattatactaatttacattcccactgacagtgtgaaaggatttccttttctcctgtaggttttcagtttgatgcaatccaaatggtatatctttgcttttgtcacctgtgcttttggagtaatatccaaaaaatcattgcctagatcagtgtcaaaaagcttttttccctgttttcttctagcagttttacagtttcaggttttatgtttaatccattttaagttgattttccctatgatgtgagaaaagatccaatttcattcttctgaatgtagacatctagttttcccaataccgcttactaaagacactataatttctccattgtgtattcttggcatttttgtcaaacagtagtggactgtaaatgtgtgcatttatttctgggcactctattctgttccattggtttatgtatctgtttttatgacagtagcatgctgtttcaatttctgtagctttgtaatatgttttgacattaggtagtgtggtgtcttcagctttgtttgtattgctcaagatttctttggctacttggggtcttttataattccacatgatttttagaatctttttcttctacttctgtgaaaactgtcattgaaatttttgtagggattgcattgaatctatagctcactttgggtagtatgaatattttaactgtattaattctttcaatccatgaacatgagatatctctccatttatttgcatatttttctatttcttttatcagtcttttatagttttcagggtacagattttttacctctttagttaactttgttgctaggtatttttaaaatgctgttgtaaaattgcattgttttgattgtttactatatatatatatagtcagtgtttatatagactaacaatgaactaccatttttagtatatataaacttcttcattgaagaagaattcagatagttcattgttagtctgtataaacactttgtatatatttcaacatttataaacatacacaaacactatatatactaacaacatttataaacatatataaatactctataaatactaacaatgaactagcttacttcttcagatagtatacataaacactactaacttttgtacattgattttgtagcctacaactttattgaatttattatttctcaaatatttttgataggtctttagggctttttatatgatttatatatgattatgacatctacagagaccattttacttcttcctttccagtctggataccttttattccttttatttgcctaattcctctaactaggacttttagtgctgtattgcatagaaggggcatccttgtcttgttcctgatcttagaggaaaaactttcagtttttcaccttaagtataatgttagctgtgaatttgtcacatatgacctttattatgttgagatacattccttctataactaaaatgttgagagtttattctgaaaggatgttgaattatgtcaaaaggttttccttcatctattgagatgatcatatggattttacctttcattctgttaatatagtgtatcacatatattgatttgcatatgttgaaccatccttgcatcttagggttaaatcccacttgatcatggtgtaagatcctatcaatatgcttttgaacttggtttgctcatattttgttgaagatttttttatctgtgttcacagggttattggcctataattttcttgtagtatctttgtctggttttggtattaggtagtgctagactcacaaattggctgataactttgattttgttttttattctaaaccactgctttctttctttttaagcatgtttaacaatcagagtcacagtgtagagcaggtccatcttccatccccctccaactctcctcatgcccttcccagttaatcctcctgtcacaacctcccaaagttctgggattacaggcgtgagttatcatgcccgacctaaaccactactttcaataaagagtgagaataaaacaatctatcataatgtttatgtttcttcatgcatacagtttgtataaagaatgtataatcatttttacataagcacttcacatctatatgaaatcccatttctattcctatctaagtgacgtgggtttgtttttctcaagacaaatggtttgttctattttaatttctgtcttactgtttttcttaatagggtagaaatgaacattttgagatttggaatcagactggtataatttgaatactagctagtctgtttattaattccgtatgtttgtttggatcacttctgtaaattccagtttctcatctgaaaatgaatacaattacagggcttacctcataggattgttttttcctgttaattaagtaaaatgagaaaggcagttaagaaagtgactattatatatcaagaaaataacgtatgatatctgttattattattgctattattaactattataaaaaccatgattggaagatgacaacagagctgaaactccagtgaaagactgaactagttaaaaatgcaccaaagccttgttattctgtctagacatgaagaggcttacaagtggaaccacatctttgactccgatttagaagggtggcatgtggaactcactatttcatcttttatcattccccagcactagacactataattactctggttatcactgtttctgggctcagatttcagcaggattgcatatctatcacaattaaaaaggcaaatgttgtatttttttaatgtggttagtgaagaaaagcttttaaataagtattctaaacctctggtttgagtacttgggaaaccatgaataggattgtaagaaggcattgagagaagaaaacttcaaaacttgcatttttgagataactttttaaaattctaatttccagtgaaaaatgtatagtgttcatgcaaatatatgcaaataaatacagctgcttttctattttaatcgtaaacctggccccttgaaatattttagcaaaaactatttgcatggaggctgtaataaacgatagtacatgtccctgttacatcaaacaaggcattctctgtatgtagactgctgcatttattattattattattcattacttcagaatcatatcatgtgaagactattgttctctggatcctggtgatggttttcattcagctgattttggcaatgattaaatttcttgttttgaagctagcggcatctcatatacaagttccctgagcatagagaccatgtcttatcttgctcatgactaaatctccaatgtcaagtacagtactcaaaacacaattattttttgataaacatttattaaatgaatgaataatgtctagtttaaatatatctagtgttttcatgatattctttatgtgttgaagcacccataccagttcccttcaaaatctgtgagcatagttctttcactgagtgtaggtatttgcaaatttgaccaagttttctgtaatagtacagaaaggcagaatcaatgctttctagaaaaaaaaaaatgaggttcagcttatcttgtcactattatgagaaagcatctctgtcccagtcataagatgtgtcatagactggaagtttctgggattttccataaaggagcagaatcacagacagtagaggggacatatggccccagtcgccctgctctgttcatggtgcctccttcctagtctaaggagagccagcaccactgcctctctcccatctgacctccactcatgactgcctagtacagcctgatgcacgctaaggccagagtagtgccatgaggaggtgtgtattttttatccccagtcacttatggctattttaaatctacggaagatcaaaaaaaaattatccttaagccaacctcatgtaattatacccattatacagaatagaaactgagttaatggaaagttaatgacaagttcaaagctgtcaaataataattctgtaatgggaacacatagcccttgaattttcctatatttatcctaagagcaggaacaatcctttttttgtctttcaactgaaaggttttattttattttatttttcatcaatttttattttaagtttcagggtacatgtgcaggatgtgcaggcttgttaataggtaaacatgtgccatggtgatttgctgcacagatcaacctgtcacctaagtattaagcccagcatccattagctattcttcctgataggctcccttccactgtcccccacaacaggccacagtgtaggtcattccctcccaggtgtccatgtgtcctcattgttcagctcccacttacaagagaatgtgcggtgcttggttttctgttcctgcgttagtttgctgaggataacagcttccagctccatccacatccctgcaaaggacatgatcttgttcctttttatggctgcatagaattccaggtgtatatgtaccacattttctttatccagtctatcactgataggcgtttggattgatttcatgtctttactattgtgaatagtgctgcaatgaacatacacgtgcatgtatctttaccatagaatggtttatattccttttggtatatacccagtaatgggattgctgggtcaaatggtatttctgcttctagatctttgagaaactgccacactgtcttccacaatggttgaactaatttacactcccaccaacagtgtaaaagcattcctttttctccacaaccttgccagcaactgttgttttttgactttttaataactgccatctaactggcaagagatggtatctcattgtggttttgatttgcatttctctaatgatcagtgatgttgagccttctttcatatgtttgttggctgcatgtatgtcttcttttgaggagtatctgttcatgtcctttgcgccccttttaatggggttgggtttttttttttttttgtaaatttgtttaagtaccttagagatgctagatatttagacctttgtcagatggatagattgtgaaaattttctcccatgttgtaggttgtctgttctctctgataatagtttcctttgctgtgcagaagctctttattttaattagatcccaatttgtcaatttttgcttttgttgtcattgcttttggtgtttccatcatgaaatctttgcccatgcctatatcctgaacagtattgcctacattttcttctagggtttttattgttttgggctttatatttaagtctttaatccatcttgagttgacttttgtatatggtgcccagtttcagttttctgtatgtggctagccagttctcctggcaccatttattaaataggaattatttcttcattgcttgtttttgtcaggtttatcaaacatcagatggttgtaggtgtgtagtcttatttctgggttctctattcttttccattggtctatgtgtctatttttataccagtaccatgctgtttaagttactatagcactgtagtatagtttgaagtcaggtagggtgatgcctccagctttattctttttgcttaggattgccttggctatttaggctcttttttggtcctatatgaattttaaaatagttttttttttttttacttctgtgaagagtgtcaatggtagttttacaggaatagcattgaatctacaaattgctttgggcagtatggccattttggcgatattgattcctcctatccatgagcatggaatgtttttttcatttgtttgtgtcctctctgatttctttgaacggtggtttgtggttctctttgaagaggtccttcacttcccttgttagctgtattcctaggtattttactctctttgtagcaattgtgaatgagagtttattcatgatttgtattttctgcatgcctgctgtttgtgtataagaatgctagtgatttttgcacattaattttgtatcctgagactttgctgaagttgcttatcagcttaagaagctttggggctgagggccgggcgcagtccctcatgcctgtaatcccagcactttgggaggctgagacaggtggatcacgaggtcaggagatcgagaccatcctggctaacacagtgaaaccccgtctctactaaaaatacaaaaaaaaaaaattagctgggcatggtggtgggtgcctgtagtcccagctgctcgggagactgaggcaggagaatggtgtgaacctgggaagcagagcttgcagtgagccaagattgcaccactggactccagcctgggcgacagagtaagactctgtctcaaaaaaaaaaaaaaagaagctttggggctgagacaatggggttttctagatatagggtcatgtcatctgcaaacaaagataatttgacttcctttcttcctatttgaatacccaccctttatttctttctcttgcctgattgtcctggccagaacttccaatactattgttgaataggaagggtgagagaggggatccttgtcttgtgctggttttcaaagggaatgcttccagcttttgcccattcagtatgatattggctgtaggtttgtcatatatggctcttactattttgaggtatgttctttcaatacctagtttattgagagtttttaacatgaagggatgttgaattttatcaaagatcttttctgcatctattgagataatcatgtagtttttgtctttagatctgtttatgtgatgaattacatttattgattagcatgtgttgaaccagccttgcatcttggggatgaagccagcttgatcgtggtggataagctttttgatgtgctgctggatttggtttgccagtattttattgaggatttttgcatcgatgtttatcagggatattggtgtgaagttttcttttttgttgtatctctgccaggttttgatatcaggatgagtctggcctcataaatgagttagggaggagtccctcctttcagttgtttggaatagtttcaatagaaattgtaccagttcctgtttgtacctctgttagaattccgctttaaatcctttggtcctcagctctttttttggttgatgggctatttcttacttcctcaatttcagaactcattattgatctacttagggattcaatttcttcctggttcagtcatgggagggtatatgtgtccaggaatttatccatttcttccaggttttctagtttatgtgcatagagctgtatatagtagtctctgatggttgtttgtatttctgtggggccagtggtgatataccccttatcatttctgattgtgaatattgattcttctctcttttcttctttagtctatctagcagtctatctattttattatttttttcagaaacaaaacagttcctggatttgctgattttttgaagggtttttttttttgtgtctctgtctccttcaattccaaagatcagaatcttatctccaagaaatgggtaaatatggtattgtgtctttgcctcaaactgcaaactttgacatctcacaaattttgaaaattccacatagccctagaagttttctgctttttcttgtttctttgaaacccatttcaatgtaactttttctttgatttgctctcttgtatacaaatctaaatagaaccacaaaaaaaaatatgcaataccatttggaaaaaggaagcaatttataaataatcaatgactaataaaaatgaaactagttttccttttttaacacttgataaagaaaagttaggtcaactttgaagcacttaataaagtgttttaaattaaattttttaggttggatttgtatctcaaagtagaaatgcctagtcagccttatcaatgaatactccttttggtttgcattacatatctgaacagtttttttcatttgcattaaatatcctaatatttttcctaatatgttaaaagatgatattgcatctgtctgatcagacatactggtccaaaacttaatttactaggatatgaaatctttgttagcttggagaaataatttccaattatgcatttcagtctcaaaatgcacacctaaacccatttaagactagctaagaacatttttataatgcatttcttagaattagctacagttatggactagtttttcttagtctttttttatgaatcaaagatagattgtctaccattcttcctcccctcccgttcaccttgttctagatggaatgaattgatgcaatttattctgtatcatttaactcatcctttatttctataaaggcaaaaataaagatataagtgtgaatccatgttttcctatttttttggcatttaaaccgaagtgtagaagattaggtattaattataattgcttaaaattcttcatagtagctttttaaataaatgggaattccaagaataattataaggtgattttaaaaacaaaaatacaagaacttatgctcctaaataattgttatccttctaggaagttatattggataaatagcaaccttattgaaataacctgtggcctgaagtaacagtgaaagacctatatggatttaaaacatctttctaccacttaaaaatagtatgatctaaggcaagttatttaagcactctgtctctcaatttaggtatctgtagattgttacaaaatggccttgagtggaagacatctccctaaatgcatcccgcattgaatcctggctggccttaggccgacagaatgtaacagatgtgacatcttgccagttctaagcctaggcattgaagagcttttgtagcttttgtctgaaatcaaaccactctgctatgaagatggcccatctaccctattggagaatgagaggtcatgtggagaaaacatgtggtagcttagctggcagccaaaagccagacgtgagcaagtccatcctggaacctccagcttcaattgagtcatccagtgacatcaccacatgaatgatcctaagtgacaccagcagaagaaacaaccagattgccaatgcacactaagaaccaagccaggtactaaattaggcagagataagggctggagtttagagattctaactccagtaatgtgctacttccacctctctgtctgaggggcaaccatctggcaatcctgagtacaaggcagaaattcagcatttggataaggaatctgctactgcttgggggtgtttgcaggaggaaatatagacatgcagttacaatgataccatccgtttctgaaaggtaagaagcaaaacacatgactagacacaacttccaagtcaagttaggagtttttcttttgtgctatgtgttggttaaaatcagaatctagcattatatgacttcagaagcttcctagttacacatacccagggaaggagaattcccataatcccataatcttattcagattaaactgatttattcacttccaattatgtgccattttttgagaaccttatcttggtaagagtagatttgggtgagagggaatcagtcttaggtagaattgaagaatctcagcaccagctaaatatttttgagcagcctatggacacgtttccagtgagagaaagaaagaggattggctaagtgtggtagctgacaccttccactgtgctcacaaagtgtgttgctctactccatgcagctctgaccagcagcattgacataatgacctccttgctacagggagcatctcaagctcagggattcaggctttttatcttttaaatagaattgccagacagcatacacgatgcccaatttaatatgaatctcaggtaaacagcaaatcatttttcagtatgtctatgcaatatttgtgacatacttatatcaaaaaatgatacactgttaatctgaaattcaaattactatttaactgggtgtcctcttgtgtttttagtcggtttgcttattttgcttcatttgttttgtttttggctaatctggtaaccctccttagaaatgaatgtcaatacagttgtgccatagaagaggtgctcaaggctgggcgtggtggctcatgcctatagtcccagcattttgggaggccgagatgagtggatcacttgagcccaggagttccagaccagcctagccaacatggtgaaaccccgtctctactaaaaatgcaaaaaatttagccaggcatgttgacatgtgcctataataccacctaccagggaggctgagatgggaggatcacttgagtccagcaggtggaggttgcagtgagccgaaatcgcaccactgcacactagcctgggaaacaaagcaagagcaagactctatctcaaaaataaaaaaaaaaagaggtgctcaataaatgctatttgaatattgattcaaactttttgcaattccacctaatttcttgtcttgttatcatggttccactaaccttttcgatgtcacagactctagtgtgattctacacagaaatctcaacccctgtaataattatagccaaaataacagtattatctatatttctgcagcagcttatggtttttcaaagagggagtacttgcttattttaaaaataaactctgagtaattacacagttaaactgtggctgtagatgaaaagaaaatggagagagtgaaaaatggtggttcatagaaagatctttgtgcttacataaggcactacatttctggttcatacattttccctcatattctgaaatcagatcgttgtttttctaacatgactgtggcaggttcaaaggaagagaaaataactaaatgtagaatactgttggctgtaggtgaacatgcattaattccctgtcatcccatttcatgccttgcaatcttccaactgttaattaagacaaacagcaaaatcatatcctttagcaaacagtctagtaccctttcccagtctgggatgtgacaggcaccacactcaaagtatgctttttttggtcatctttatatagcataatagaccaaccaagtacaagttaagcagactgaaaggaagaattatttcacactcctgctgatgctgctggaaagtgtagaaatgatcttggagtgcttcctttagttctttatcctttagaatagctcacagaaggcaacctaacaagcattaggattcacaatgccatctgtctgttaaaaatatagtctaattccaaagaagggcattacataatagtaaagggatcaatgcaacaggaagagctaactatcctaaatatatatgcacccaatataggagtgcccagattcataaagcaagttattagagacctacaaacagacttatactcccacacaataatagtgggagattttaacaccccactgtcaatattagatcaacgagacagaaaattaaaaaggatattcaggacttgaactcagctctggaccaagcagacctaatagacatctacagaactcttcaccccaaatcaacagaatatacattcttctcaacaccaaattgcacttattctaaaattgaccacataattggaagtaaaacactcctcagcaaatgcaaaagaatggaaatcataacaaacagtctttcagaccacagtgcaatccaattagtactcaggattaagaaactcactcaaaaccccacaactacgtggaaactgaacaacctgctcctgaatgactactgggtaaataacaaaattaaggcagatataaataagttctttgaaaccaatgagaacaaagacacaatgtaccaggatctctgggacacagctaaagcactgtttaaagggaaatttatagcactaaatgcccacaggagaaagtgagaaagatttaaaattgacaccctaacatcacaattaaaagaactagagaagcaagaggaaacaaaagctagtagaagacaagaaataactaagatcagagcagaactgaaggagatagagacacgaaaaacccttcaaaaaaatcaatgaatccaggagctggttttctgaaaagattaacaaaatagactgctagccagactaatgaagaaaagagagaagaatcaaatagacacaataaaaaatggtaaaggggttatcaccactgatcccacagactaccatcagagaatactataaacacctctacgcaaataaattagaaaatctagaagaaatatataaattcctggacacatacaccctcccgagactaaaccagggagaagtcgaatccctgaatagaccaataatgggttctgaaattgaggcaataattcatagcctaccaacaaaaaaaccccaggaccagacaaattcacagccgaattctaccagaggtacaaagaggagctggtaccattccttctaaaactattccaaacaatagaaagagggaattctccccaactcattttatgaggccagcatcatcctgataccaaagcctggcagagacacacagaaaaaaagagaattttaggcaagagaattttaggccagtatccctgatgaacctcgatacgaaaatcctcactaaagtactggcaaaccgaatccagcagcacatcaaaaagcttatctaccacgatcaagctggcttcatccctgggatgcaaggctggttcaacatatgcaaatgaatcaatgtaatccatcatataaacagaaccaaaaacaaaaaccacatcattatctcaatagatgcagaaaaggccttcaataaaatttaacaccccttcatgctaaaaactatcaataaaataggtattgatggaatgtatctcaaaataataagagctatttatgacaaacccacagccaatatcatactgaataggcaaaagctggaagcattccctttgaaaaccagcagaaaacaaggatgccctctctcacccctcctattgaacatagtattggaagttctggccaggacagtcaggcaagatcaagaaattaagggtattcaaataggaagacaggaagtcaaattgtctctgtttgcagatgacatgattgtatatttacaaaaccccattgtctcagcctaaaatctccttaagctgataagcaacttcagcaaaatctcaggatacaaaatgaatgtgcaaaaatcagaagcattcctatacacctataatggacaaacacagaaccaaatcatgagtgaattccctttcacaactgctacaaagagaataaaacacctaggaatacaacttacaagggatgtgaaggacctcttcaaggagaactacaaaccactcctcaaggaaataagagaggacacaaacaaatggaaaaacattacatgctcatggttaggaagaatcaatattgtaaaaatggccatattgcccaaagtaatttatagattcaatgctatccccatcaagttaacattgacttttttcacagagttagaaaaaactactttaaatttcatatggaaccgaaaaagaacctgtatagccatgacaatcctaagcaaaaagaacaaagctggaggcatcatactacctgacttcaaactataccacaaggctacagtaaccaaaacagcacggtactggtaccaaaacagatgtatagaccaatggaacagaacagagccctcagaaacaacaccacacatctacaaccatctgatctttgacaaacctgacaaaaacaacaatggggaaaggattccgtatttaataaatggtgttaggaaaactggctagccatatgcagaaaactgaaactagaccccttccttacaccttatacaaaaattaactcaagatggattaaagacttaaatgtaagacctaaaaccataaaaaccctagaagaaaacctagacaataccattcaggacttaggcacgggcaaagacttcatgactaaaacaccaaaagcaatggcaacaaaagccaaaattgacaaatgggatctaactaaacctaagagcttctgcacagcaaaagaaaccatcatcaaagtgaacaggcaacctacagaatgggagaaagtgtttgcaatctatccatctgacaaagggctaatatccagaatctacaaagaaacaaatttacaagaaaaaaacaaacaaccccatcaaaaagtgggcaaaggatatgaacagacacttctcaaaagaagacatttttgcggccaacaaacgtgaaaaaaagctcacgatcactggtcattagaaaaatgcaaatcaaaaccacaatgtgataccatttcatgccagttagaatggtgatcattaaaaggtcaggaaacaatagatgctggagaggatgtggagaaagaggaatgcttttacactgttggtgggagtgtaaattagttcaaccattgtggaagacagtgtgtcaattcctcaaggatctagaaccagaaatgccatttgatccagcaatcccattactgggtatatacctaaaagattataaatcattctactataaagacacatgcacgtgtatgtttattgtggcactgttcacaatagcaaagacttggaactaatccaaatgtccatcaatgatagactggataaagaaaatgtggtacatatacaccatggaatactatgcagccataaaaaaggatgagttcatgtcctttgcagggacatggataaagctggaaaccatcattctcagcaaactaatacaggaacagtaaaccaaataccgcatgttctcactagtatgtgggagttgaacaatgagaacacacagacacagggaggggaacatcacacaccagggcctgtcagggggtggggggctggggagggatagcattaagagaaatacctaatgtaaatgatgggttgatgggtgcagcaaaccaccatggcatgtatatacctgtgtaacaaaccttcacattctgcacatgtatcccagaacttaaagtataataataaaaaaagtacagtctaattcattagacactgatatatatatatatatagctttgtttgctagttatttcttattgctctctgttgacccgaaactaagtcattaagcagcaggaaaagtaataagagctaattttctgttcaagtcaagaaaatgtgctacctttatagtgctttaggaagtcttcatcatcaaaaaatactaaagaatactggaagaggaaagcatttacatattaaagtggtaaaaagatagaggccaaagtctatacaagagataaaactaatcaaataacagccataactcttaagggatatgactgtctgcaaagactaacatttccttctactatttaagagaaaataaccccaaatcaaaaccagaaaattaaatgaactgaagacaatttattgcaaaatatgacaatctgtacaaactttgtgagaatggcatctctttgtactatgctccagagtttgtctaatctttcaaggatgaaatgtttacccccagttgtggttctctgagatctatgtttcttacttgattagacacaggacaaaaatctcaaaagaatcctttgagatttttttgcatttatatttgagatttacatttatatatttatatgatatatttgtatataaatctgtgcattatgtattatataaatttggcaatttagataatgtattctccttagtgatatctaaggagctatcatattcccttcttagttatcttcccaggagtgaagtgaggtgatatgaattgagcaattgaggcagattttaacagcaattcctctggatcaggactaaatatttttgttggtggtgcttgtttttattctgcatatattatatatatatatatatatatatatcattaaatttaccttttaaaatgactttaagtgtataattcagtggcattaattatattcataatgttgtacaactatcactactatctatttccaaaaccttttcatcatgccaaatacaaactcagtaactattaagcaataactctccattctcccctctgccaatactggtaacttctaatctactttttatcactatgaatttgcctatactagttatttcatataaataataaagtatttgtccttttgtgtctcactcattgcactcagcataatgatttcagggttcatccatgttgtagcacatgtcagaactttattcttttttatggctgaataataatccgtagtaagcatatacattgtgtttatagagtcatcttttgatggccactaggttgtttacaccttttcgctattatgaataatgctgtgatgaattttggaatataagtatatgtttgaatacctgtttcaaaaaacaaaaaaaaagattgtttcctgttttgaaaaactgctgcaccacattacactcctaccatcaatgtatgagaatttcggtttctccccatccttgccaacgcttgttttccttttcattttgtttatttatttcagtagatttagggggtacaagtgggttttggttaaatggatgaattgtgtagtggcgaagtctgggctttgttttttgttgttgttgtttttcagacagattctccctctgtcgccaggctggagtgcaatggcgcaatctcggctcactgcaacctccgcctcctgggtttaagcgattcttctgtctcagcctcccgagtagctgggagtacaggcgtgcccatgcccacctaatttttgtgtttttagtagagacggggtttcaccacgttggccaggttggtctccatctcttgacctcgtgatccgcccacctcaacctcccaaagtgctgggattacaggcgtgagccaccgcacccggccaaagtctgggcttttagtgtgcctatcacctgaaaaatgtacattgtacccaataggtaatgtttcatccctgacccctgcccctctctgagcctccagcgtcctttataccactctgtgtgcctgcatccccttagcttactccctcttataagtagaactaagtatttttgactaaagatttggagcgccatgctgcctccatcctcatcagaaagcaccatgttgccattcgatggaaacctttgacaatggagcaccatgctgacagacgagaaccaaaaggaggctccagggctgctgccccacgtgccatatattctgactgtatggcaggttcttgaattcactgcttcaggtcctttgaattgtaacaaatgccttcaggttacaagcccttagtttattatgacttgtgtgcttcctttttacagccctaacaaacataagactcttaatgtaaaggagatctgtagagaagcttcacttacactctaatttggagatttgtcaacatcagtgtattaatccctttcctccctccctctctcttccttctatgtgagtttatcatttgaatgtaaacatttgcctttgaactgactggataattggttcggagactctttaagcatttatttagaaagcaaagttcaggtttaatttccctacagttacatagtatagtgaggtgggaatcttcactgcatattccagctgttttgatataattagatgtttatgctatgtccacatccgcttttcccttctcacactcctctagttttccctgtaccattggtttataaatcactcccaaactgcccctccttaatcaggccaggcagaagccagcggccccatgccagcggccagcagctggagatgtggggtcgcagccacgcggcgtgacccagggtcagaaagagtgggccagagagaaccatggcccgcactgctaacttccaggacatccacaattttcattcccaggaagagtctttcctgggaaaggtacagaaatttcagttgctctagcatgtagtgggattttataatgagccaggcaggaaaataacagatggtgcactgagtgtaaatatatgaaaatacccttggagcagaaacagaaggctggcactcccaggggactcgggcgaaaacagacaagactccccgctgtctctcagctcttctaatgtttttctcacgtcttaaggcacagacaatgtctattgcatgtaacatcttatattctctcaccttagtgcaccaaatcgtgatcctcttggaggccctcccctctgatctctgtgccctctaatctccttgcttcctcctctctgctcaggtttgctttcttgggtctctcctctttcatcttagctgtttctccaggctgtttgaaggttcccacctccgttctttcttggttctggatctgtctgttagaatgactccaactccagcgctgtggctttcaccatgtttcttcactttcatgtctttttttatttataattgagcacacacacacaccacacacacactctctctctctcctatacttccttctttagaaagctttctgctgttgttgttgttttaataatctttcagatcattttatttagctttcatccatttccctcattaaagtcagttgaaagttttgtcaacatgtaatatgcatttgatataatgattttagtataataattacctgaggtaacactgtgtcagaggagaagtgtggccaattatatcttaaattacatgaacagcgctttccctttcacacagctatacatttctttaggcactaaaaatctgtaatctgtagcttccattaaattggatttagttgttttgcaaataaaattgtggaataaaaggttgtattagttactgttctccagagaatgagaatgaatagggtgtatgcatgtgtgtgtgtgtgtgtttacaatcagttgactctaagtaaagcagtggagagcaatgggtgggcctcattcaatcagtggcaggcctaagagcaaagagagatttctcaaaaaagaaggaagtttcctcaagactgcaacatggcaaagctgctcagtagactcagttagtctattgccctgcagaatttggactgaaagctgtgacatcaattctttcttaaaactctgagagattgcttgattgattttaaggaattggcttacatgattgtgggggctgacaagtccaaaatctctagggcaggccagcaggctggagactcaggacagagttaaagttgcagtcttgcatataaattctgcagggcagtagtttggaaactcaactgggtttctgtgtggaagtcttgaggagaattctttcttctttgagaaacaggctttgtttgcaatctttgctcttaaggctttcaactaattgaaagaggcacacctgtatgatggagggtaatctgctttacttaaagtctactgattataagaattaatcacacctaaaatatacctttacttcgtggcaacaacacacactgggaacgactagacaggggcaagggttgaaaaactaactgttgggtactatgctcactctccgggtgacaggataattcatggcccaaacctcaacatcaagcaatgtacccacgtaacaaacctgctcatgtacccctgaatctaaaataaaagttgaaattattaaaaagaaatattgaaggaatgatataaagattttaaatgaataaataataataccttgactggtgtttggccaaacagctgggcattctagtcctcgccaagtcaacacacaaaattaaccattacagtggtgtttccccatttgtagggagagggaaaggatcacatttaatgaaaaacatttttgtttccgaatgtatatttctaactcatttttctttgaattttcttatattttcatgtttatacagaaatacggtatattggcatttaatttagcacaaaacttgagattcgttattctaaagttttaatattttgtgatgctctacaagaaggactgtaactcccagacacaaagctacctgcaagttcaagcattgctgctttttacatgaaatgtcatggtaactggcaaggattccccaagggcctagaagtagtggaagtcagattccccttatatgcagtgtactgtatgaacatatttacatcctccaacaataggctgcctttagcagcctgtaggtttggaaaacactatttttgtttgggctccgggtccagccatttcaagcctggtaataactgcggtctccctcaccaccttcctcaccaactggaatggtgtgttggaatattttcagctgttaattacataatacctcaaaacagtgcttaaatagatatttttgtccacataaaaataatctgaaggtaggtggttccaggttagtaaagtggtcagtgatgtcaggagccgagtccacatctctctgggtctgtggcctcccttcacagtcgcatgagagctgctgtagctctaggtgtctccttacaacaccatggtgcttgaaagcaggaaacgggtgggagggaacaaaaccttcttctcatacatttcccacatttcaggtagaaaaagtttcccggaggcggaggttgcagtgagctgagatcgtgccactgcacgccagcctggcaacggagcgagactctcttaaaaaaacaaacaaaacaacaacaaaaacgaaaaatgtttcccagaatcctcggcacaggtttctgcttccacctcataggccaaattgatcacatgttcttccctagccaatgaccgggcctttctcccctgacataaggggatctctcctgtcaaatgaatacaataaggttgggttagcaagcaagaaagtgggtgtggatgccgttgaatagctgcagcaatatctaccagatgccacccctttggccgcttggcattcacactcaccctccttccacacatacacaacacatcagccctcactgcacaaatgaggcccacagcttccttcagctccaacgccatgatctcaggtgaccacctggactctctgtcaagtccaaatgttgctcctcacaaatgtctcctatagtaaagcataagccatctgtccactacatacctaagacatagaaatggagaaggaacaagttaaccctaataaagccttgtatttggcagaggggagaacaggaaatagtaaccacttgtttacagcacatatcagatactgctcagcaggaatagtgaggaccatatattctggaaatggagtaagctcctcttagctgctctgagagccctgattctttctttcagtagattttcttgtccattttaccacatggcaattttggaatgcacattggagagtaaggtcttcctaggggctgtagagattgcgcagccctcttcctattggtggaattgtggggaactgggaattgctttgaggattgaactttcacagaattctgcagccagccttggaagttctgttagcacaactccgttatcttaaaaatttagtatgcttgttgtcacagaaattaaaaaaaaaaagacatcataacttctgaccacaataaaattaaaagtaaaaataaggttttttaaggcataagaaaagtcttatgattaaaaatacactcataagtaatactaattcctgctcaagaaagaaattatgatatacatttaaaacaatagaaaaaaatggaaatataccatatatcaaaacctgtacacggcagataaggtggtatttagaggttaatttgtagccttaaataaatatctcaaaaacattatatgtagccttaaataaatgtatttaaatagtttttaaaatgaagaaaaccattcagctaaaggcactagaaaaagaacaacagcataaacttaagttttgtggtttttttttttttttggagacagggtctcactctgattgcccaggttggagtgcagtggcgtaagtttggttccctgcagcctcaacctccccaggcttctcccacctcaacctcctgagtagctaggactacaggcgcacaccaccatgcccagttaaatttttttagttttgtagagatgcagttttgctgtgttgcccaggctggtcttgagctcttggactcaagcaatccacccaccttagccttccaaagtgctgggattattacgagtgtgagccactatgcctggccaacataaactttaaaaagtagaaaataaacttaattctaaaattttaagagcagaaattactaaaaagaagaaaaaatagagattaacaaaatcaaaactgattattgaaggaaaattaataaaataggcaacattctaagaagactgagaaaaacaaaataagaaaaaatacaacattagaaattttaagagcagagatactttaagatttcaaaacgtataacgggatacgttaaaaactttatgacaatattttaaaattagattaaatggatactttaataaaaatggcaaaaatttgacaagaagaaacaaagaatctggataacataataataaagacattttatctcatcaagatgtaaataatttctattttatataaactttttcaaagaagatgaaaaaattacctatctcattgagtgaggataaatcttgctttgtaaggatagaataacactgacaaggacagtaaacgaaaagaccatatgacctactagaatataaatgaaaaaaatcgggggaatagcattaggagatatacctaatgttaaatgatgagttaatgggtgcagcacaccaacatggcacatgtatacatatgtaactaacctgcacattgtgcacatgtaccctaaaacttaaagtataataaaaagaaaaaaatcctaattaaaatattttcaaattgaattcaatagtatattaaaaatgataatacttaagtagcattttatccctataaatgaaaatctggttcaagagaagaatcctctaatgtcgtttaccacataagaaattacactggtggttgccgggtgtaaggggaggggaaatgggcagttcttcttttaaggacatagagtttcaattttggaagatgaaacagttctgaagattggttgtacaacaaggtgaacatacttaacactactgaactatatatttagaaacagttaaaatagtaagctttgttttttctaataaagctttttaagacattgcagaacaaatatataaattttatctcaatagatacagaagtgttcaataaaatcagtggtcatttataatttttttaaaattagcacatctgaactataaaggagtttccccactgtggttggctcgataacgatccccttatgtccacatcctaatccctggaacctgtgaatgtcaacttgtagggcaaaagggaccttgcaaatgtgattaagaatctcaagaaaggaagagtatcctggattagctatggggcccagtgtgattacaaggatccttagaagagggtggcatgaggagtcaaagatcagaaagagacgtgatggtggcagcgtttggagtgacgtgctttgaggatggaattccttggctgccaagggattcaggcaggcactagaagctgaaaaaggcaaccaaacagatactttcctcagagcttccagaaaaaaccagcccaacagacaccttgactttaccttagtaaagctgattttgcaatctggcctccatgactataagaaaataactgtgtgctgtttttaagtcactgttttttgtaagttgttacagcagcaaagggaaactaatacactcaatatcattgattcatttattcaacaaatatttagtacagacctgtcatgtattaagcgcttttccagactctggagatatcaaaataaacaacaaaaaaagcttcaaacaaaacagtaacaacaaattctaccctgttgcacttgtattctaatgaggaagttgagggtaaataatcacaaattagtaaaaaaaaataaagttagacaatgatcatctccaaggagaaaaataatgcagggaggagaggacgtacacatcatggtagaggaggtattgttactgaaacaccaggtgctcggtctaggctctgctgctcaccgcacagaaagccaatcactgagatgatgagtgttgccaaggaagaaggctttaattgggtgctgcagctgagaagatgggagctcagtctcaaaatccatctccctgactgaccaaaactaagggtttatatatcaggaaagaaatgtaacaacgtgtaagaagacaggaactccggaggagcaaaaaaacaatcataatgaatgagaggtggcatcccattatctggatgtgatgatctggtgagttccagttccttgatccttttcttgagaggcatgaaggttgtttccggaggaactcagataaaataaatataagtttcaagctttaagaccagagggtcaacttctatgtttatcaaaaaataaaataaactatctgtgggactattgggtcactttcagtgagatgcatttctggattgggagggtaggataggagtcaattaaaaagtgtcattggagtaacatcggaggaagtaaggagcagggccttgtatgtgtctgggataagagcactacagtcagaaaaaagtagcgagtgtgaagtttagaggcaggggcgtgggcctgtcaggtgagagaagaccagtgctggagtcaagggagccagaggagagtcccaggagatgaggtcagagaagcaaggatggctgtagaccatgccaggccccacagattgcaatgagggctgagggcacactggggaccctttgtaaggtctttttttaaaaaattattattattatactttaagttttagggtacatgtgcacaatgtgccagttagttacatatgtatacatgtgccatgctggtgtgctgcacccattaactcgtcatttaccattaggtatatctcctaatgctatccctcacccctccccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctcaaaggacatgaacttatcattttttatggctgcatagtattccatggtgtatatgtgccacatttcttaatccagtctatcattgttggacatttgggttggttccaagtctttgctattgtgaatagtgctgcaatgaacatacgtgtgcatgtgtctttatagcagcatgatttatagtcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgattgccattctaactggtgtgagatggcatctcattgtggttttgatttgcatgtctctgatagccagtgatgatgagcattttttcatgtgtcttttggctgcataaatgtcttcttttgagaagtgtctgttcatgtcctttgcccactttttgatggggttgtttgtttttttcttgtaaatttgtttaagttcattgtagattctggatattagcctttgtcagatgactaggttgtgaaaattttctcccattttgtaggttgcccattcactctgatggtagtttcttttgctgtgcagaagctctttactttaattagatcccatttgtcaattttggcttttgttgccatttcttttggtgttttagacatgaagtccttgcccatgcctatgtcctgaatggtaatgcctatgttttcttctagggtttttatagttttaggtctaacgtttaagtctttaatccatcttgaattaatttttgtataaggtgtaaggaagggatccagtttcagctttctacatatggctagccagttttcccagcaccatttattaaatagggaattctttccccattgcttgtttttctcaggtttgtcaaagatcagatagttgtagatatgcggtgttatttctgatggctctgttctgttccattgatctatatctctgttttggtaccactaccatgctgttttggttactgtagacttgtagtatagtttgaagtcaggtagtgtgatgcctccagctttggattgacttggtgatgcgggctcttttttggttccatatgaactttaaagtagttttttccaattctgtgaagaaagtcgttggtggcttgatggggatggcattgaatctataaattaccttgggcagtatggccattttcacgatattgattcttcctacccatgagcatggaatgttcttccatttgtttgtatcctcttctattttattgagcagtggtttgtatttctccttgaagaggtccttcacgtcccttgtaagttggattcctaagtattttattctctttgaagcaattgtgaatgggagttcactcatgatttggctctctgtttgtctgttattggcgtataagaatgcttgtgatttttgtacattgattttgtatcctgagactttgctgaagttgcttatcagcttaaggagattttgggctcagacagtggggttttctagatatacaatcatgttgtctgcaaacagggacaatttgacttcctcttttcctaattgaataccctttatttccttctcctgcctaattgccctggccagaacttccaacactatgttgaataggagtggtgagagaggacatccctgtgttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggtcttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttgttggttgtgtctctgcccggctttggtaccaggatgatgctggcctcataaaatgagttagagaggattccctctttttctattgattggaatagtttcagaaggaatggtaccagttcctccttgtacctctggtagaatttggctgtgaatccatctggtcctggactctttttggttggtaagctattgattattgccacaatttcagctcctgttattggtctattcagagattcaacttcttcctggtttagtcttgggagagtgtatgtgtcgaggaatttatcaatttctagattttctagtttatctccgtagaggtgtttgtagtaatctctgatggtagtttgtatttctgtgggatcggtggtgatatcccctttatcattttttattgcatctatttgattcttctctcttttctctttattagtcttgctagcgatctatcagttttgttgatcctttaaaaaaactagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggctgttcagtttccatatagttgagcggttttgagtgagtttcttaatcccgagttctagttcgattgcactgtggtctgacagacagtttgttataatttccattcttttacatttgctgaggagagctttactttcaactatgtggtcaattttggaataggtgtggtgtggtgctgaaaaaaatgtatattctgttgatttggggtggagagttctgtagatgtttattaggtccacttggtgcagagctgagttcaattcctaggtatccttcttaactttctgtctcgttgatctgcctaatgttgacagtggggtgttaaagtctcccattattattgtgtgggagtctaagtctctttgtaggtcactcaggacttgctttatgaatctgggtgctcctgtattgggtgcatatatatttaggagagttagctcttcttgttgaattgatccctttaccattatgtaatggccttctttgtctcttttgatctctgttggtttaaagtctgttttatcagagactaggattgcaacccctgcctttttttgttttccatttgcttggtagatcgtcctccatccttttattttgagcctatatgtgtctctgcacaagagatgggtttcctgaatacagcacactgatgggtcttgactccttatccaattcgccagtctgtgtcttttaattgggacatttagtccatttacatttaaagttaatattgttatgtgtgaatttgatcctgtcgttatgatgttagctggttattttgctcgttagttgatgcagtttcttcctagtctcgatggtctttacattttggcatgattttgtggcggctggtaccggttgttcctttccatgtttagtgcttccttcaggagctcttttagggcatgctcggtggtgacagaatctctcagcatttgcttgtctgtaaaggattttatttctccttcacttatgaagcttagtttggctggatatgaaattctgggttgaaaattcttttctttaagaatgttgaatattggcccccactctctttgggcttgtagagtttctgccaagagatccgctgttagtctgatgggcttccctttgtgggtaacgtgacctttctctctggctgcccttaacattttttcctcatttcaactttggtgaatctgacaattatgtgttttggaattgctcttctcgaagagtatctttgtggcgttttctgtatttcctgaatctgaatgttggcctgccttgctagattggggaagttctcctggataatatcctgcagagtgttttgcaacttggtttcattttccccatcactttcaggtacaccaatcagacgtagatttggtcttttcacatagtcccatatttcttggaggctttgttcgtttctttttattcttttttctctaaacttcccttctctcttcatttcattcatttcatcttccatcactgttaccctttcttccagttgatcgcatcggctcctgaggcttctgcattcttcacgtagttctcgagccttggctttcagctccatcagctcctttaagcacttctctgtattggttattctagttatacatttgtctaaatttttttcaaagttttcaacttctttgcctttggtttgaatttcctcctgtagctcagagtagttcgatcgtctgaagccttcttctctcaacttgtcaaagtcattctccatccagctttgttccgttgctggtgaggaactgcgttcctttggagtaggagaggtgttctgctttttagagttcccagtttttctgctctgttttttccccatctttgtggttttatctacttttggttcttgatgatggtgatgtacagatgggtttttggtgtggatgtcctttctgcttgttagttttccttctaacagacaggaccctcagctgcaggtctgttggagtttgctagaggttcactccagaccctgtttgcctaggtatcagcagcggtgtctgcagaacagcggattttcatgaaccgcaaatgctgctgtctgatcgttcctctggaagttttgtctcagaggagtacccggccatgtgaggtgtcagtctgcccctactggggggtgccttccagttaggctgctcgggggtcaggggtcagggacccactttaggaggcagtctgcccgttctcagatctccagctgcatgctgggagaaccactgctctcttcaaagctgtcagacggggacatttaagtctgcagaggttactgctgtctttttgtttgtctgtggcctgcccgcagaggtggagcctacagaggcaggcaggcctctttgagctgtggtgggctccacccagttcgagcttcctggctgctttgtttacctaagcaagcctgggcaatggcaggcgtccctcccccagcctcactgccgccttgcagtttgatctcagactgctgtgccagcaatcagcgagactccataggcataggaccctccgagccagttgcgggatgtaatctcctggtgcgtcatttcctgagcccgttggaaaagtgcaatattcgggtgggagtgacccgattttccaggtgccgtctgtcactcctttccttgaccaggaaagggaactccctgatcccttgcgcttcccgagtgaggcaatgcctcgccctgcttcggctggtgcacggtgtgctgcacccactgtcctgcgcccagtgtctggcactccctagtgagatgaacctggtacctcaggtggaaatgcagaaatcacccgtcttctgtgtcactcacgctgggagctgtagaccagagctgttcctattcggccatcttggctcctcccccccttgtaaggtcttgaacagaggagggataaaagataaaattcaactcctgtgttacaaacattgttctagtgctgtttaggaaatcgtctgaaagaggagaagagtgataccaggaaggccaattaggaggttaatgaaaaaacattagcccaaaatgatggtgccttagaccagggtggcagtcgtgaagacggcaaaaagtaattttgtaaatatttatataaagtagaactgccatgatttactgacaagctaatgtggcgtgtaaaagggttttggcctgggtaactgacagaatggatttgcctttagtcaagatgaagtagagtgagtttggttggggaaggatggaaaataccaggcattcagtttgaaatgcacaatttgtcattcaagtagaagtgaaaagtaggcagttggacatacaaatttaaacttctgaaaaacttaacaaactagagatataaatttaacataatcaaaaataggtagtattcaaagccaagagtgagcatacatagaagaaagaaacccgggaactcattcctggaactccaacacatcaaagtaaaggagatgaggaagaactagcaaagagagtaagaacagctggagacgcagaaagaaaagcaagagaatacagtgctctaaagtccaagaaagctcttcatgaagagtatgtgggccccatatacctgattagccacgtaaaatggggactcagcatgacccagcggtttcagtcacacggagggcagaggcaaaaatgggcagccggtataggcgcacgacggacagcacacttcatgatgacactttggaagcagcttcactgaattttcagggaaagacaaacatgccctctttcatctcttctagtcacaagtgtaccagagcttaacgacaacaacaacaaaacaggaaaaacaaatgaagtacaagaagtggatggaaagaggtaaaaactcttctctgctgtttatatgatgtctgtatacaaaatccaagataatctacagataaacacttagaaactgataagagattttaaaatgtattagattcaagattagcatgcttgaatcaaactattctaccatactaaataaaaacatactttttccattaacttcctataagcagttacgtgctggttacttgaagacaggaaaggaaagagagacacctgatatgcggtgattgctgatttccaaggtgcaacttctcctcccacagcccatttgaagctaccagtgtaatgtcactgaagcagaactgccaatagttgcacgtaactggcccttgcaaactggtgtcagcgccagcacaccactgcaaatcaactaaaatgttgaataaagaaaacatcacattcatagatgttatcaaaactacaagatctattttaaaaaactaaccaaatggcaataacatgcagagatcttttttaaaaaatgttttaaattaagaacggaatacttcagaaaaagtaatactaatggcagggaagaattgatattgttgatgccaattcaccccaaataattataatttcagcacagttataatcaaatctcaacagagaatcttcaaattcatttgaaagaggaagtggtcaaaaataattgagacagtttttaagaacaacaaggtagggtgacttgcactactaaaaaataaatccctaaatacttgatattgatgttaggatgaacaaataaaacaatgtaaccgaatagagagcccataaacagttatttttagaaacctgatatataccagatgtggtattactaattagtgtggaaagagtggcctctcaatcgatggttctgaggctattgaatttccatatgggaaaataaacaaaattcaaatttctctaagacaagaaaaaaataatccaccaagaacaaactgaacaaattgcaaaatataacaaagggtaattatctcaagtttatagggagctcttaaaatgaataaatatattaaaccaaatagaggggataaatccacgaaaaacaatagttaaagttagaaaaataaagagcctattttctttttttttttttaattccttcttaaaaaaaaacgggatacatgtatagaacgtgcaggtttgttacataggttgcgtgtgccatggtggtttgctgcacctgctgacccatcctctaagctctctcccctcacccccaccctccagcaggccctggtgtgtgtggttcccctctctgtgtccatgggttcttgttgttcaactcccacttaggagtgagaacatgcggtgttcggttttctgttcctgtgttagtttgctgaggatgatgaagagcctattttcatttaaaaaatcaaaatgtattttaaagtactcaaatccattaagaatgtttaaaactaattttaaattaacaaaatacttttatttccctatcaaaatgaaaaaaaagtaaaagactgatttttaaaaaatccataatctgtgttcaagaacttatttctccatacagtaagggcaactttacagccaaacatattttccaaacttggcagaagtataaattggcaaaacctttttggattgagatatacttacggaaatttaagtataccttctttgaccaaaaaattcaaaaagttatcctaaagaaagcagaaaaagtataaagggtcatatgtagcccatttaagtgaagaaatggaaaattctttgataaccaaaaaaactagttcatagaagttccatatagtatgatgtatttttcataaaacaaaaaaagtatgtatttgaatgacttaaaattttctagaagtaacatgcagaagtgagtatttctccatgctgaagttacggagttctgttttcttgtttatattttgctgtgctttcttaattttgcagtattactcatatattaggataaatcattttcaaaaaaataagcaaagcagacatgcacttggggtttttacaaaatattttattgacaagtattatttttaaagtattatttttaatgtattatctcccaccctaggagaaaattttgtgccctctcctaggatgggcttaactataagaatgttgcaaataaggaaaaagtgagtagtatgtaccaccactctctctattttgccaactagctcagctccccctggagtccttcatgcgcatgttcccattggatgaacctcccacgtgatgtttcttggtctctaaaccaatgagtctccgtgagtcaatatccctacatcacacacacacacacacacacacacacacacactctctctctctctctctctctctctctctcgtatgatgactcctgaatcatactgtgtattaaagttgcttattcacatgtcatcttcctggtagactataaagccccagagaataagacaaatgcactattctttttatatctcccagaaacaattaacaaaataccctgcatatactgatgtaaattacttatttgttgactaaatattgcaaggacttcataggtttaacttggactaattcatggttacggttttttgttttgttttgtttttgttttttagatggagttttgctctgtcgcccaggctggagtgcaatggtgccatcatggctcactgcaacctctgcctcccaggttcgagcaattctcctgcctcagcctcccgagtagctgggattaaagtcatgcgccaccacgctcagctaacgttgtatttttagtagagacggggtttctccatgttagtcaggctggtctcaaactcccggactcaggtgatccacccacctcggcccccccaaagtgctgggattacaggcgtgagccaccacacccggccagttactttttataaattgaaaataagtaatttttaaagaaataaaagtcctttttatttaaaaaataaataattacacaaattatgaatgacattgggttcaactacaattatatttgagaagattacatttaattgatggataaatgatctgtagtgatttatgattggaaacataagggacaccttttttcctatttttatctgtgccatagaagccaaaaatgttctttcataaaacatactttgaggcctctgttagagacagacagtaagaatgcatgaaacagggtctactctaatacatcaatttcttagttatcatgaagtattttatttgctggatacaaagagattgatgtataaactaaattgataataacagctaccatttactaaaaacctgccacgctgagtgtcttgtgttcattctctccaaccccataaaaaaccttgttgtatagtgagggaaggagcagatattctaactaagctctattaactgcaaaaccaaaactctcaaccaatagatccacttttttacagatatactaaaagcagtttagtagcaatttcagcaatgtagtcaaagtttctggtgctatgtcttcaaattttcatggatcataacacatctgcagtacagttgtgatcaaattattatatccactgcatttaccaaaaataaaatgatacacaaaaagtcctcaggaaaactattctcttgaaatatctttatagtgatgcctgggggaaaatctcgtttagctaaagtgctgtttgtaattagcatggcattcccttttacgtctaaaaatagaattacaatcatcattttaacactatatatacattggtctagcttttatattttatttggatgaaaatagaatagcaaaaaagtccatgttttctcaaaaatacttacgatgaaagctggatgtattaacacatatctagcttataaaactagctacccaatagagtataatgaaatattgttcctttatttagcaattgctttttatctaggggcacagatcactgacgaaactataagaaaacaatgcaatgcaactgctatttcagtcttgcatgtgcccgggtgtaattaacaaatgtatcatatgtaaacaattacatacttcatagtacaattccaaactcaaatctcacattttagagacctacctttagaaaagctctttcttttctttagatttgatcatactgcttcagaaacactgtaagtttcacagggaaaggattattttgcaaagttgcagatccaatacattgctttggttttacatacaaagtaagtatgggaaaatttatcatgcaaataaagaggttcaacaaaatatcatacaggtatcttctattcatttttgtccagcactttgtaatttgagtgacacgtcctggccaggcaatgcactatgtggcaagagtgtagattcaggaactagatcatctggatatcacgcagcttcatgacaagcacattggtctccaggactgcattgtgggtgaccctaataaacttactcagatatttgaatagcttctctattgtttgatagagaaaaaagaatggctggacataacaccaatttttgattaccaaagctacaattctttgttttgggttttcttgagacagggtctcactctgtcgccagctagaatgcagtggcacaatcccagctcagtgcagcctcaacctccagggctcaagtgatcctcccacctcagcctcctgagtaactgggactacagatgtacaccaccacgcccaggtaatttttaaatttttttgtagagataagagtctcactatgttgctcaggctggtctcacacacctgggttcaagcagtctccctccttggcccctcaaagtgctgggactacagatgtgaaccgtcgtgcctggcccaaagaattacaaatcttaacctttatccgaagtctaatgaatttgatataatgctttattgaggataaaagaattaatttcagctaattatcttcaaaaaggatttttatttaaaaattctgtccttgcatacattttctggacataagctaggacatcatttcggtctgattttggttacaaagtgcacaggcgccgcttcaatctgctaatcaagctttaatgtgtcgtgttatgttgctctcaaattgtgaacatacggtagtttataaataaacgtctcaaggacttagtttctgaagattacggagctggaagagctactcagagaaactgaaataccttctaaaatgtattttcaagtttcttcttaaatcttcaaattggattattagagagaaagcatgaatagatctgcttcttccctttggggattgagagaggtttcgtgtctttaagaagcctcttgaaatatacagatttatttaatatatgtcagaatctagagagaattatgatatcaaatgctttttcggaaatgcagtgtatataatagagaatatgatattgttttctgaacttctttcctacatcctacgatattcaaagagtaattcagcatggcctccagccctgcagctcatccctgtgcgttttggattcaaggactccagcctgcagtggccaacaggaaatacagtaattgtgatcttgctctttgaagatgggatgataattatcacagaactcataggaaatgtcttttttgctctatagactgtgagattatgcatatcttttagtagtttattccctgaatccttaaaaattaatttaagtttaccatcagattttagattttcctctattcctacctttggttatgacatcagttttgtgaacaaagtaaactcaatacattataaaatgctgaagtaacatatcattttccctaaggcttacctcttttatttgatttaaggaaaatttcttattttctgtgggggcttagtgcattgatgtggagaaattcatccttcttggtttttgtattcttttttttttttttttttgagacggagtttcactcttgttgcccaggctggagtgcagtggcgtggtctcggctcactgcaacctgcgcctcctggattcaagcgattctcttgccccaggtttttgtattcttaaaggccaaaacatatgtctggatggcctcatgctcatctgtgcacaccatggcagaacccagtacattgttttgtttacatccccccaaaatagtgaaaaaaatgaagcaccaccatttttatcttgagcacctcttcactgttcttaacgcatttgggcggtagcagaaaagatcattccccaaaaccttgctaagcacgttgtccaggtggggagagtattactgctcagttttccagttacaggtgctctagtatctttcttctaatttaggcatcactggcaacaatcaacttgtcagatttatatagtagatgaaaatggaaaagagaaaaatcgagtccaaggctgcttttattctgaagtttaaatggcagctattatcatttcatgtagcccattatgtaggaatgatgtctaggactgtacagtttcatcatgagtttccatgagcttcttttcatttttacatcttttattttaatcagtgggaaatcacgatattagagattccactggtgccctgaaagacatgctttgtgaaatttttgtttcaaaacattatttcaaaataaataatgtatacttaattcagcaccaggacccatgattagatgcaaatgagatgacatgaaatatctttactgtgctatttacattcatatatgtttacttgtactttaaatcctataacaaaattatgtaagtaaacccaaagtataatgtttagagaaaattagttcttcacacttcaatatttatgaagtacaactttttgtaaacatggaaaattgaaaaatgtcattgaaattaacctgtagaataatatggattaaataaatgctattgctgttcctctgactttaaaaaatcaaaagcactttctagattaatctgagtaatcacaggccgcttaaagtagccaggaatataaagtggaacaaccaacctcagttccctgcatccgaaggtttagacctattttagttcatctcacgctgctacaacgaaattccacagactaggtaatttataatgagcagaaatttatttggctcaaagttttggagtctgggaagtccacaattgagaaaatgcatctgcatctggtgagggacttctgttgtgtcataacatggcagaaagcatcacgtggggagagagaggaggaggccaaactcatccttttacaaggaactaactcctgaaacagtggcatcaatccattcatgagagggaagccctcatgacctaaccatctgtgatggtcccacttttccacactgctggattgaggattatgtttctaacccgtgaaccttgggtgacgcatttaaaccctagcaacaccctagctgattcacagatatttatgctaaagcctagttgatacagtttgatatttgttccctcaaaatcccacgttgaaatgtgatccccaatgttggaagtgcagtctagtgggaggtatttggttcatgggagtggattcctcagaatggcttgatgccctccctatagtaatgagtttacacaagagctggttgctcaaaacatcctgacatctctcttgcttcctccctcaccgtgtgacacatctgctcctccttcgccttccaccataagcggaagcttccggaagcctcaccagaagctgagcagatgctggagccatgcttgtacagcctgcagaactgtgagccaaataaacttcttttctttaaaaattacccagcctcaggtattactgtgtaggaatgcaaatggactaacacactagttattttcagatatttgtaagtattatcatccttcatccaaatacaatttttaacatattttaaatgaaaataatttaagaaatatggagctggatagtaaaagagaaaaaaatgttatcttaatataattttagtgggtttatacatcaaacattaagtgggagaggtctttaagcacttgcacaaggctgaaaaacaaggaaaaggaagttacctcgtagatgtctaacagagatgcagaactgatctgcagcagcagttaggacaaaggcaatcatatatggaaaagcagataatatgatttttaaagctttgagacatttccaatttggagtaacagaatgttagccagcacgtgccaatacagccttgccagttacttattgctgacattcattctgattagcccattattagcctgagctgagctgattagtgtagtttacatctccctgggttaactacagcccatcctcattatttgcagattccagatttatgaatttgcctgctcactaaaatggatttgtaaccctcaaatcaatactcccaagtgctttcctggtcatttatggacatgcacagagaggggaaattatttatttatttatttatttcaataggttttgggggaacaggtggtgtttggttacacgcataagttctttagtgatgatttctgagattttggtgtacccatcacgcgagcagtgtacactgtacccaacgtgtaatattttatccctcactcctctcccaccctttccccaagtccccaaagtccattgtatcattcttatgtttttgcatcctcatagtttagctgccacttatgaatgagaacatacaatgtttggttttccattcctgagttattcacttagaataatggtctccaattccatccaggtttattttgttcgtttttatggctgaatagtattccatggtatatatttataccacaatttcttttttattattattattattatactttaagttttagggtacatgtgcacaatatgctggttagttacataggtatacatgtgccatgctggtgtgctgcacccattagctcgtcatttagcattaggtatatctcctaatgctatccctcccccttcccccaaccccacaacagtccccagagtgtgatgttccccttcctgtgtccatgtgttctcattgttcaattcccatctatgagtgagaacatgcgttgtttggttttttgtccttgagatagtttactgagaatgatgatttcccatttcacccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatgtataccacaatttctttatccacttgttaattgatgggcatttgggctggttccatatttttgtgattgtgaattgtgcttctataaacatgcatgtgcaagtatcttttttcctgtgatgacttactttcctctaggtagatagccagtagtgggattgctggatcaaatggtatttctacttttagaactcagttctttaaggaatctccacactgttttccatagtggttctgctagtttacattcccaccagcagtgtaagtgttccattttcaccacatccataccaacatctatttttttttaattttttgattgtggccattcttgcaggagtgattttgatttgtattgtggttttgatttgtatttccctgataattagtgatgttgaacattttttcatatgtttgttggccatttgtgtatcttcttttgagaattgtctattcatgtccttagcccactttttgatgggattattgcatcgttaggcaacttcattattgtgcaaacatcatagagcgtactacgcaaacctagatggtatagcataatacacacctgggctatctagtaaaatctattgcttctaggccacaaacctgtacagcatgtgactgtactgaacactataggcaattgtaacatagtggtatttgtgtatctaagcatatgtaaacatagaaaaggtacagtaaaaatatggtataaaagataaaaaatggtacacctgcatagggcacttaccgtgaatgaaggttgcaagattgaaagttgctcttggtgagttgatgaccagtgaatgaatgtgaaggcgtaagatgttactgtgcactactgtagactttataagcactgtacacttagactatactaaatttattttttaaatttcttacctcaaaaatagattaaccttagtttactgtatcttttttacttataaacttcttaattgttttaagctttgactcttctgtaaaaacacttagcttaaaacagaaacatattgttcggctgtacaaaaatattttctatctttgtatccttattctataggcttttgtctgtgttcaacctttttttctacttttaaaattaaaaaaaaagctaagacatatgcacacacattagcctaggcctacaggaggtcaggatcatcaacatcactgtcttccacctccacatcatgtctcactggaaggtcttcaggggaagtaacatgcatgaagctgtcatctcctatggtaacaatgccttctgctgcatacctcctgaaggacctgcctgaggctgttttacagttcactctttttaacataagtagaaagagtacattctgaaatgacaataaaaatttagcatagtaaaatacataaaccagtaatttagtcatttgtacatgtttgtacgtgctagtctttaaatgactgggagcacagtaggtttctttacaccacatcaccacaaacacaggactaatgcattgtgctaagacactatgatggctacgatgtcactaggcaacagaaatttttctgcaccattataatattacggaaacaccatcatatatgtggtccgttgatgatcaaaacacattaccggcacatgactgtatgtataagtacaaattggataaaatatatgtaactttattctatctaaaattatttcccagagtaatgctaagtatttttaaaataatgttctttcacattaaaagtcaatgaatttttgtggtttttgttttttgctaataataattttttttaatttctaacttttaagttcagaggtacatgtgcaggatgggcaggtttgttacataggtaaacatgtgtcatggtggtttgttgtacagattatttcctcacccaggtattaagcctagtacccattagttattttccctgatcatctccctcctcccactgtccgccctcccatgggccccagtgtgtgttggttcctcctatgtatccatgtgttctaatcattcagctcccacttacaagtgagaacatgcagtgtttggttttctgttcctgtattaacttgctaaggataatggcctctagttccatccatgtccctgcaaaggacatgatccccttcttttttatggctgcataatattccatggtatatatgtacattttctttattcagtatatcattgatgggcatttaggttgattccatgtctttgctgttgtgaatagtgctgcattgaacatacacatgcatatgtctttacaatagaatggtttatattcctttgggtatgtacccagtaatgggattgcttggtcaaatagtatttttctctctaggtctttgaggaattgccacactgtcttcaacaacggttgaactaatttacactcccaccaacaatgtaaaagcattcctttttctccacaaccttgccaacatctgttgttttttgactttttaataaacgccattctgactgtcaagagatggtatctcattgtggttttgatgtgcatttctctaatgatcagtgaatgttgagctttttttcatgtgtctgtttgccacatgtatgtcttcttttgagaattgtctcttcatgtcctttgcctacttattaatggagtttttttccttataaatttgtttaagttccttatagatgctagatattagacctttgtcagatgcatagattgtgaaaaatttctcccattttgtaggttgtctgtttactctgttgatagtttcttttgctgtgcagaagctctttagtttaattagattccatttgtcaatttttgcttttgttgtaattgcttttggtgtcttcaacataaaatcttttcctgtgcctatgtccggtatagtattgcctagattttcttctagggtttttattgtcttgagttttacatttaagtctttaatgcatcttgagttgacttttgtatatggtacccagtttcaattttctgcatatagctagccagttctcccagcaccatttattaaatagggaatcctttccccattgcttgtttttgtcaggtttgtcaaagaccagatggttacaggtgtgcagtcttatatctgggcactctatgctgttccattggtctgtgtgtctgtttttgcaccagtgccatgccatttgggttactgtagcactgtaatatagtcaggtagcatgatgcctccagctttattctttttgcttaggattgccttggttattcaggctcttctttggttctatatgaattttaaaatacatttttcttttttttattatactttaagttttagggtacacgtgcacaatgtgcaggtttgttatatatgtatacatgttccatgttggtgtgctgcacccattaactcatcatttagcattaggtatatctcctaatgctatccctcccctctccccgcaccccacaacaagccccgttgtgtgatgttccccttcctgtgtccatgtgttctcattgttcaattcccacctgtgagtgagaacatgcggtgtctggttttttgtccttgcgatagtttgctgacaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacacacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggcatctcattgtggttttgatgtgcatctctctgatggccagtgatgatgagcattttttcatgtgtcttttggctgcataaatgtcttcttttaagaagtgtctgttcatatcctttgcccactttttgatgtggttgtttttttcttgtaaatttgtttgagttcattgtagattctggatattagccctttgtcagatgagaagattgcaaaaattttctcccattctgtaggttgcctgttcactctgatggtagtttcttttgctgtgcagaagctctttgacaaacctgacaaaaacaagaaatggggaaacgattccctatttaataaatggtgctgggaaaactggctagccatatggagaaagctgaaactggatcccttccttacaccttatacaaaaattaattcaagatggattgaagacttaaatgttagacctaaaaccataaaaaccctagaagaaaacctaggcattaccattcaggacacaggcatgggcaaagacttcatgtctaaaacaccaaaagcaatggcaacaaaagccaaaattgacaaatgggagctaattaaattaaaatacatttttctaactgtgtgaagaatgtcaaaggtagtttaatagaaacagcattggaattagaaatagaaatctataaattgctttgggcagtttggctgtttacacgatattgattttttcctatccaagcatgaaatgtttttccgtttgtttgtgtcctctctgatttcctttaacaggggtttatagttctccttgaaaaggttcttcacttcccttgttagctgtattcctaggtatttgattctctttgtagcaattgtaaatggaagttcattcttgatttggctctctgcatgccttctattggtgtataggaatgccagtgatttttgcatattgattttgtatcctgagactttgctgaagtggcttatcagtttaagaagctttgggactgagacgatggggttttctggatacagaatcatgtcatctgcaaacaaagataatttgacttcctcccttcctatctgaatgccctttatttctttctcgtgcctgatcgttctggccagaacttccaatactatgttgaataggaggggtgagagagggcatccttgtcttctgctggttttcaagggggatgctttcagcttttgcccatccagtatgatattggctgtgggtttgtcatttatggctcttattattttgaggtatgttccttcaatatctagtttattgagagtttttaacatgaagaaatattgaattgtatcaaaggctttttctgcatctactgagataatcatgtggtttatgtctttagttctgtttatgtgatgaatgacatttattgatttgcatatattgagccaaccttgcatcccagggatgaagcctacctgattgtgatagacaagctttttgctgtgctgctggattgtttgccaatattttgttgagaatttttgcgtcgatgttcatcaggttattggtctaaaattttctttttttgttgtatctctgccaggttttggtgtcaggatgatgctggcctcagaatgagttagggaagagtccctccttttcaataataatttttattagtttaactatttccacttcctcttttcctccccccggtaacttgtaggcatacacattatcttgacttctcaagacacgatctcagaattctccattcatcagtctgcaagaactctttgcaacaaaaccatttaaagtctaccagagcctaggtctctggagcattttgtttgcagttgtttataaccaacttccagaaacactgaatgtcaattgcagtatactttgaaaagaagttatttgtcactatagatttcttaccaaatttagtttgttgcaacggaaaggccttttattttaggtgaaaaatgacttctgatttgatttagtcaaagttttaatttaggttttctagtttcattttctttttcctcttctctaatcttataaaaaatatcccactactgcaaaatgtgcctgcttgctataaacaaaagcaggctctaatagagtaaaaagttacaaacatactaagatgtctaattaagatacttattgtaaaattggaaaaaatatttataaaaatagagaattttaaaaaatcgaattgccaagcatttctaagtactcacaattctacattgcacaggagatgtttcactcctgtaactaaattttaaacaaaagaaatgagcttttaatcttgggcacctagaaatagttattaatatagaaaaatacaaagttctataacacggaaccaatatgatatatatggttattggtcttatgttagatcttaagataaaactttttcaaatagatattcaaacagtacaatacactgaaaatttttctaaaaccttttctatttacataacattttatttctgaaagcaaacacacatgccaaaaaggctgagtttaccaaggttacaaaatgaatcagtgaaaggacgaggaatataatttaaatctcagattttgtggtagtatctaatagactcctcatttccattaatttcctaaaatatagtattgttttatagagaaagcaaaagcatttcacattttttctgcagtaagctgttagagtgtaatatctttggagatcaagactccgcattgctcttctaggtgtctacatgaaaaataactgattccactaaagagtagagaggaaaaacaaaactggaatcaagcaaatatgaggacttacaaacatacaaaaggtttatttttaaattcactaagaacactaaacgtgtttctgattctcaattttaaattttgtttttgttccaacaattccaactggattttacacaattggatttaatccaaaactctatttccatttaatagcacggaaactggacctgatatttgtttaaaaggaggccttggcctccttacattaccctttcattgattcacagccttgcactcagaaagtgtataccacaaaatggagatatcccagcaagaacagagagagagagaggagaagggttggggagctggtgtgtcctgtccccttgctgctgacagtgactgtcatacagacaggactcaactctctgtccatttgtctcttttcaccaacctttgccttcaaggccattaaactccctctattcacttagcttcaccaccaccaactcaatgcctatgtcagctatctattgctgtgccacacattaccacgccttggtggcttcagacagcacacattcattatcacaggtttctatggttggaaatctggacgccacttagctgcctcctcggcttcagcgtctcttacaaggctgccatcacagtgtcgacggtgctgctgtctcatctgagggtcacctccaagctcacgggggttttggcaggcttcagttcctcgcagactatcagactgaggacctcaggcccttgctggctgctgcccagcagctgccattggttcttgctatgtgggcttcttgctatggcagcattactctatctgagccagcatgggagagcggcaatagggagagtggcacagtaaggcaagagttaaaatcttatgtgacataatcacggaagtgacatgctaccacctttgctgtactcttatggttagaaacaagtcacaggtgccacccacagctatgggaaggggatcagaccagggtgtgaataccaggaggcagagatcactggggacatcttcgagcctatctaccaggaggcttgagctcaggcccaggtctattggccctagaccagcaatccattatttcagccttaaatcagattcttagaacttcattttggtgataaactagtttactgtttttgttttttcgttgttgttttttgtttttttttggcttgatacctggttccaagagcaccgtgtcccagccttgctcttgatagcggaatacttgcctgcaaatgtttccccctattttctgaatgtatcactccttcatttctcctcgccgtatgttctgttttgggccccggcatgaatacactgcctctcatgcacatttgcagactgcccactgctgaatctcccgcgaggtttttcgacaactggttagttgaatactctgaaaatacgctagtatctttggctaatagtgcttgtagcacatctctatggaccccacagactaacagctgcttttcaatcctgatacgtatttctttgcacagatttcctaaataaacaagtcttattcacatattgtgacacttgccattctcctgacttttaggtcggcctggtttcctgaccttaacttgttctttctgacccaccctgacagtgcctgagctggggctctgatacatgtttaattgccagcaaaaccctttatctcttataaatccctctccagttcgagttccatatctaatcacaacattcacaaggatttaagaaaatacaactacttattgaagcacaaatctataatgatggagaaaataggctttcaaagaaagtatgtttttatactaaatatttaaaactgtcaaactacttattctggaggtttctattttttaacagacaggtcaagtagaagaaaaggcgattctctaaagaacattattccaaaaagtacatctctgtttaaatcatgtttttgctctttcctgtgcctcagataacctcctgtgtcatccatttttacatgtcaaaagcccatctacacttgaggtccatttcactggatacttcctccttggagttttctctgatcaccctaacccaacacagtgagtcccctctctaaacccccaaacaatactcatactggtcgtggggtatgtcatacatactactttttatattctcctttcatgatcctgatgggttgtaaatgtctgtataccaaaaacaatgtatttcttttttttttttttaatactttaagttctagggtacaggtgcacaacgtgcaggtttgttacatatgtatacatgtgccatgttggtttgctacacccattaacttgtcatttgcaataggtatttctcttaatgccatccatccctccccactcccgccaccccacaacaggccccaatgtgcacacgtatgtttattgcggcactattcacaatagcaaagacttggaatcaacccaaatgtcacatatacaccatggaatactgtgcagccataaaaaagatgagttcatgtcctttgtagggacatggacgaagctggaaaccatcattctaagcagactatcgcaaggacagaaaaccaaacaccacatgttctcataggtgggaactgaacaatgaaaacacttggacacagggcagggaacaaaacaacgtatttcttacttttctactcattgagatagattcagtgtcaacatatttttagtaaatttatatgagtaacatagtaatactcaaagttttattatgaatagacaatacccgctttaggagacagagttgaaatctttaatatcatatgtaatttcattaaagatctaaatgtctaatatcttatgtgatgttagtatttattaaatgatattagaaataaactgcaaaactcattttttgaaatatttaccacagttaaatatatcatagataataaatacattttcattttctttgccttgtatcttcctatttcttagtaatctaccagtttaatttgggcatatctgtacccctaaaataaaaaatgttgcatttttgtatgtggatacattaattcaaagtatagtagcacttgaaataccttgaaggtcttaaagcatcacaaagctgaacgttagaatcagtatctgatctgaataaagatgacctctctatggctgcagcatcagctgcaaaagcctcaccaagggggtctgcaggaaatgcggagggcagtggggtgccccagctggatcctacttgccaggaggcactatctctctggtagctgggagtactgatagaacagggctctcagctgtcagtcctctttgaggattgcttcagctaaagaatactgcttcacccaagcccacagctactgactaaccaacatacttactctgtggggcaactctgaaaggtcattctggctccagagctctctgtagattaggctaagtccttcactggatcttcatttcagctcaactgtgggccagtcttgctttcatctcctccctcctacaggtgttaatcctaaaattatttcctaataaacaccctgcttaaaaattttcatctcagagtctgttccccaaagaacttaacttgcagcaaacactagggttgctcttgggagaagagaggatttccacaaagagataaaatgattattctttgctgtttctacctagagaaggttttttccaacctttggtactattgatgttatgagctggataattatttgctgttaagggctaccctgtgcattgtaggatattgagtagcatccctggcctctaccactagatgctagtagcacacgtgcatatgtgtgcacacaagcgtgcacgcacacacacacaacccatgtgacaaaaatgtctgcagatattgccaaatgtcccccgaagggcaaaatcctccattgagaatgtctgccctaggactaattctggcgataggagaacaacaagcaatgaaagaagctggtgcctcccagatgccaggggtagcagttgacaggacacaggtaagcggaggcccggcacaggcagtcaggaacaccttcctccgccacccagcccttgactgcacccccacacctcaccactgggttagctgtgaagagctgagactccataatttggaactagaggtcagtcgatcattttggggggtgcactgtcatgtatggaacgtctttcatcctgctcaatgcatattcactatttataggcttctgaaaggtgtcacattctcttcagtctttgatgaaaagcaggattctccaattccacagagaagctgtaggttttagttgtttttttttcctcttcaaattcttgaagtgccagtgttcttaaaggctttcctgatctgctttaaatgtcctgggtatgcatttaagtaagagagacacttccttcacatataatctcttcaattgcaggggaagctagggtattgggattctagagaatttccttcactcttgaattcctcgatttacatagaaaaagctggagttgggggaaatgagatgtacaattgaggcagaaggaagtatcagagctatacaggaaccagcataaacagaatatctgtaagttgggacatattcaaaatactatcactaagtgctccaattaccactactactattattgtcacatttccatccacatactttttttccttcttttttctgttttttaatggaagtatgattgatatatgaaaaagcagtatatatttaatgtatacatcctgatgagtttggagataagtacatatctgaaatcatcaacagaagcactgccgtaacgttacccgtcactggcccaggttcctgcctccctctctttttgtgtatataataagaacatctaacataaagtctaccctcttcataaatgtttacatatataatatggttttgttaactatatgctctatgctgtgccgatctccacacttattcatcctgcgtcagtcaccctagggacgcttagattgacatctatctgctgcccactccccccagccatggtacccaccattcgactctctgtttctatgaatttgactattttagactcgtgacataaatgggatcatgtactatttgtcattttgtgcctagcttatttcctttagtgtcctccaagttcatctatgttacaacaaatggcaggatctctctttttttttttttttttttttgagacagactttcactcttgttgcccaggctggagtgcaatggtgcgatcttggctcaccgcaatctccacctcctggttcaagcgattctcctgcctcagcctcctgagtagctgggatttttttttacaggtctgcaccaccacgcccggctaatttttgtatttttagtagagatgtgatttctccatgttggtcaggctggtctcaaactcccgacctcaggtgatccacccgcctcggcctcccaaagtgctgggattacaggcatgagccaccacacccagccttttttttctttttaatttcaacttttattttagactcagggggtaaatgttcaggtttgttacactggtatattgcctgatgctgaggtctgcggtattaatgatccatgagcatagtaactgctagtttttcagccctcactccccttcctccctttctttttctggagtccccagtgtctgtgtttgtcatctttatgttcacaagtgtccagtgtttagcgcctacttataagagagaacatgtggtatttggttttctgttcctgcatttgttcacttaggataatggcacccagatgcatccatgttgctgcaaaagacatgatttcattcttttttatggctgtgtagtgctctatggtgtgtaggcaccacattttctttgtccaatccactgtgcatgggcacctacgttgattccatgtctttgctattgtgaatagtgctgcaaagaacatacctggcatgtgtctttatagtagaatgatgtattttcctttcgctgtacacccagtaatgggattgctaggttgaatggtagccatgttttatgttatttgagaaacatccaaactgctttccacagtggctgaactaatttacattcccaccaagagcatataaatgttcccttttctccacagcctcaccagcatctgctattttttgactttttagtaatagccattctgactggtgtgagatggtgtctcattgtggttttggtttgtatttctctgacgataagtaatgttgagcagtttttcatgtttgttggccatttgtatgtcttcttttgggaagtgtctgttcatgttctttgcccactttttaatggggttgttttttgcttgttcacttgtttaagttccttatggattctggatattagatctttattggatacagtttgtgaatattttcccccattttgtagggtgtatgttagctctgttgataatttcttttgctgtgcagaagctctttagttaggtcccacttaccaatttttgtttttgttgtagttgtttttgggatcttagccataaattccttgccaaggctggtgtccaaaatggtgtttcctaggttttcttctagattttttaaaagcttgaggtcttacatttaaattcttgctccatcttgagttaatttttgcatacgctgaaaagtaggagtccgggtttaatcttctgcatttggttagccagttatcccagcaccatttactgaataggaagtcctttccccattgcttattttagtcaactttgtcaatggtcagatggttgtcgttgtgcagctttatttctgggccctctatactattacaattggtctatgtatctgttttttgtatcagtactatcctgttttgattactgtagccttatagtatagtttgaaatcagataatgtgatgcctccagctttactctttttgcttagggttattttggctattttggctattttttggttccatatgagttttagaatagtttttttctaattctgtgaaggatggcattggtagtttgataggagtagtgctgaatctgtagactgctttaggcagtaggccattttaatgatattaattctgccaatccatgagcatggaatgtttttgcatttgtttgtgtcatctatgatttctttagtagtgttttgtagttctccttgtagaaatctttcacttccttagttagaggtattcccaagtttttttttgtagctattgtaaatgggactgcattcttgatttgactctcagcttgaatcttattggtgtatacaaatactcctgttttttatatatactacattttctttatttcatcttttcatggacatttagattgtttctatgtctttgctactgtaaataatgctacaatcaacgtgagagtgcagatatatcttcaagatcctgatttcaattttgggaggtttatactcaaaagtgggatggctggatcatatggtagttctatattaaattttttaggaacctccatattgttttcaatagttaatgtactaatttacatttccaccagtgtacaagagtgcccctttctccgtatccccaccaacacttgttgttttttgtttttttgtgaatagccatcctgacagatatgagatgatgtcttgtggctttgatttgcatttccatccacatattttttaagaataaatagaaaaaggaggtgcttttatatatgtgtgtgtcacaaaaggattatatgcaaaccaactgcaaaatacaaatgctgcatttcagcactgtctttaacctttgtcttaatttttgaatttaagattttacaatagctataatttattttctgttaaccaacttaatttttacatgcttactaatgcacctttgtatcatagtgtttagcattagcaacactgtgggagaagaggcagagaaaatatccatgaaatacaggtaatctttaattttatgagacagtttcttcccatgaagaatttataactttctcagctctaatcaaattccctgccacaggagcacgttctaattagagccatctgctcctagcaggatattcatcccaggccaatgtatggtgaaacattctaatccattttaagcatctaatttgtttctgcactaaaattctaggcaaagagcagctggatgtcattggagacttttcctgcacaatgagggcaaggaaagttaaaacagaaattcactgagtggaaaccacggatctgtaattaggaaatattaatctaggacatgcagtgataaaaatcaatgaccagctgctcatatcatgcttattgaagtagttgaccctagaaaaactactaccatctcatttgttcataggcttttcgccactcctttttttggatcaagagacatggatttattcatccatccactcatttattcattcacactaccaccattgacaatttttgagcaaggcactgtgctttgtgctaaagacaatgggtacagatgtaagtcactgatctggttttcaaaagttgatagacagtgtaaaataatttcaagagtgttttaaaaggtcattttaaaacttatcttgggggcagaaaggaaataatgtatgcaatagtctatttttgttcctaccatacatatagcaattaagtgtaagtattatattattccctccagaacttgtatattattacataattacaagaattgagatatctcagatactttgtaaggatggtacatctttgacatagttgtttatattcaaatgccaccatgaaactcagagtagatacaggagctataaaaggagaaaaaaaaagactattcaaatttccattaattggaaatgattttaaaggaaaatgtaaaataccaattcaggtgtcaatgaatgactcctaggggacaagttaacacacacagacacacacacacacacacacacacacacaatcagaagctacctcctgttagagtctatttttctattggattttaaaatttctactttaagtcacaattaaatgcaaatacttaacagaactgttcttgagctcttcattgctaatagcctctgctgattttgccctcttcttctctacccctttgcttcagctccagtttcccaaatttctgtgacggggtgaaagagtacactgagagagagaaaaacaccacacctccggaagacaaagggatgcaatcacctgatccagaggagattatttctttaaaaaaaaaaaaaaagtcacacacacacacacacacacacacacacacatgcgaagctttgcatactgaagtgaacaccaacagtttcagatttcaaaacgaatggacccatgtgcacacgggcacatagacatacacacacacacacacacacacacacacacacgacatgatttatttcagcagagcatcagaatgcaataataaccaaaaaggtatcatatattttacaattattctctattaaatgtggaaccaagattaagctctagtgacaaaaaaaaaaaaaaaaaaaatcctagacccaggaccagagcagctggtggctacaggtaatgtcactgaagtggttcagctatgacagaggctcaggtgtagactgctgagcagaaacatccttgtgggtacagacgcgcttccactggtccgcaaagaaacacaatccaccaatttcaaatgcaagttcatcctggaagcaaacctcagaactacactgatgacataatcgatgcccacattaagaatggaggcccagcactaaaggaaagctgtctctaaacaagtcatcacagaagcatatctgtgattattgccagtaatactttgtcagccttaattcatcctttctatcacaagagcctatagtaagagacttagcctgtaaacagttgactctgagctcatttcaaatcagcaacacataggcgagagttataaataatgcatgcagtgatgctgcagaatggtttgggtgcatgcagaatgaatgaccgtgttgcatacgtcttaaaaagtgtcgatttacttttgttcacaactggatagtggctaagcatagacatttgtataaatattcgccaagacgagtcttccaacaaaccatactaattaggatgctgtaaaataatcgcaaaccaaaagactgctgaatagtttacaggtagggcatatgtgggccctaggacaatgtatattctatttggcatattcatcatggatttagaactaatagagatcctatctttttagtgcctgaagtggctaaaaaatatcttcttaagtggccaagcgtggtggctcatgcctgtaatcccagctctgtgagaggccaaggtgggaggatcccttgaggccaggagttggagagcagtctaggcaacatagcaagaccccgtctctacaaaaaaaataagaaaattatccaggcatgatggtacgtgcctgtaatcacagctattcaggaaactgatgcaggaggatcacttgagcccagaagttcaatgcttcagtgagctatgatcacatattttatacataaaatatgacatattttatattcgaggatatatataatatatatcttttagttatcttgatgggaatgggtggtttatacttcccaaaacccaataagatatttaaacatgttttttcatgctgaagttatttatttactgccatgttcaggaaagtatgatggaaaagaaataaagagaagaggagaaataactatctttaaactgcctcccaagattcacagataagctatacaaaaactctaagctctggcctatcaacgttgttggtgtttggggatcctttttcaccagctctactttaagcttctattaagcttgccaaattgatttcagatttgttatacgcctggcacagcaggcactatttaaaatgtatgttcctggcagctgaggtggggcagtgccgtccagtctcaacgtcagctggccttgtttggcaccttcatcacatgtacatgctcctattaatctactgtctaacaaagatctggaaaagcctagtatcttcccatattaaagccagatcattaaagaaataccacttgagattgtatagaagggcaagaaaataattcttaatttctaaaccaaattggtttcatagaaattctgcctttggctgatcacttcactttagtagagcaaagcaataaatttttatcccttttcactgaaacccttggttatctctgcaccagggaagaaaataatgtcttctattaagattaatattgttatgggaatattactatgattattattataaattcacctccatctttgcttgtttgcttgtttggtttgcttctttcttctttgaatacaccatacctgaggaagcagaatcacatggctgatgatatcaaactggcttaatgtaattatggactagttgtgaataaaaatatgtactgaccgcttattatgtgaatagcactgtgttaggtaaataatgtttttcttttacccaatggggaaatgatctcttcccacaaagagtccagtgattaggttgggtaagaaagccatagccatgaaagaattaatgaacagaagtgtgctctagtgcagagtcatttctactgaaagcatcagagaggcttcgcagaaagattggaacttgaggtgagtcaggaagtttcataaaagatggataagtaggccaggcgcagtgcctcacgcctggaatcccagcactttgggaggccacggcgggcggatcacgaggtcaggagatcgagaccatcccggctaacacagtgaaaccccgtctctactaaaaatacaaaaaaaattatccgggcgtggtggcgggcgcctgtggtcccagctactcgggaggctgaggcaggagaatggcgggaacccgggaggcggagcctgcagtgagccgagatcgcgccactgcactccagcctgggcgacagagccagactccgtctcaaaacaaaacaaaaagaaagatggataagtagacagaggaaggaggagctggcttggcaccaagtctaaggtatgaaagaacatggtttgtaatataggaaagcacaatctatttataatacacacatacttaaatatttaaaattgattcaacaggttaaagaccaggctttgccaagagtagataccagtattcctatggtttggtctttcaacgagtagactctttgaagtgtttcaatatattgtatttcccaccgatggagtttaaaaagaaagggaaagaaaaacagtgcaaatcgattcctgctgacaacaacacctacacgttgctctttgggagtaactgttttccaagttgtaattaggatcttttgtccattctacgtaaggtatggtaacatcacaaatacaaaactgcagtggattttatattttaaaatataaataatgaattagatgtcatgatgaccagctgcttagctgattttaccactcatggctatttgaccgggttcagaagggcaagagccattaacaagggtaattacctcctgcgcctctctcctcttccgcagaccctggcctgtaataggtgccattccaggcactccctcagtgctgaatgaatacataaatgaatgaattgtagatatggcttcagataataaggaaattcaaactactgcatgctctttgcccaaaatgactgtgtggaaagaaaataaatactgcttctattaagatattccttcattataggaggtcatatgagaaggttgggagaagaagggagaacgatagtaataacaagggatttctcttcatctttaatgctaaggatcaaagacctttctcctatttgaggctgactgcatttgcattgtacacctttagatgatgaataactagacatgttgtgtgtatttatgattgtgggttaaattttaggctgtgaattctgatgtcaaaatttagaagcactgacctctacttattcatgtattggtaacaaaaagaactttccaaagttttccaaatttggtatcaccttagaagagctaacctcattttacacttgaataacccagtatttcattaagcacttaatatgtatggagttcagttagctattgttcagtaatccaatagatgttattgatttttgggacttatcttgggggagataattcagagacaggacaggacaagaaaatattaaagagttaattaactagacagtgtaacacacatatagtaagtaccatataagtcaattaaatagcattgtaggacttaaggaaagtaagaatcactactagtgaaatattcttggatgacttcatggagaaaaaacaattgtgccttcgaagaagggtgtgatttagaatgttgaagaagaaattcgagtgtgtttcaggaattcattcatagcatgaagagaattaccaacagccacgacatgtttagagcaaaatgcagactccctttgataagggcggctgttcttatgggagtggggaagttgatagggaaattacagtttcattcagcatgtagagagccttaaatgacagcctaggcttttaagacaattccgtaagctgtgattggtgatatgataaaaggagtcattttaagaccatttatctaatgcgtatactagtgtgcaagatacgtttaaggtgggatgtactagaggcaggaaaccagctgagaagctaagagccaagcacaggaccctaacagccacagctccagtgacagcaacaggactggaaaagaaagaatggaagagtgacagttcaaaaagagagatcaggctgtgtgtggtggctcatgtctgtaatcccagcactttgggaggccaaggctagctgttcacaaagtcaggagatcgagaccatcttggccaacatggtgaaaccccatctctattaatatacaaaaaattagcctgacgtggtggcatgtgcctgtaatcccagctacttgggaggctgacgcaggggaatcacttgaacccaggaggcggaggttagagtgagctgagatcgcaccagtgtactccagcctggtgacagagcaagactccgtttaaaaaaagaaaaaaaagaaaaaggatggaagagtgacagtttaaaagagagatcaggccatgcaccgtggctcatgcctataatcccaacactttgggaggctgagtcaggtggaccgcttgaacccagaatgtggaggttgcagtgagccaagatcacgccactcaaaaaaaaaaaaaaaaaaaaaaaaggaaaagaaaatcagtggcactttttgaccaattggacttgaagagaggttctaaaggtgatttaaaccaaaacaactacaaaaatgagcccagaaataaaggcaattcatgtacaactcagagagttggaccagctgaccactaaggcctcaaacaaacaaagttccactccttgtgtctgcacaaattatgttcctctctctcccctttgcctgtccagttatggctgtgtattaagatctatttcaaatctctccactccttgaaaaactgcatgactactccctgttatgtgcaagatcctccttgggctcccgatacattcacttctcttccacataatcacgtgtgtcattgcatcctctttttgctacagtaattcttttccctatcaatccctccaccctcactagtttttattctatcttacaaaagctagcactgaattaaatatgaactggtataaaacacaaacttacagctagaggtaaaaaatcttaataaatgcatctcttttactagaccactagaaatgttaatacccaaaggatacagggaagcctattggcactgaatattcaaaaatttaaataagctcttttgaaacttgaagctgaaagtctttctagatattcaagtattatctatggaaataaatcaagaagccctggaaaagtgtggcaaacaccttccattgctaaaggaacaattaaaaagcctattctaagaggcacaacggagctaaccattttctatgtcgtgcaagcggaaataattcagtgatgtctttgtgcctctcagaaaatcacacaaagtcactttctgctttttagtttgctctttggccctatgtaaaatgttgccacagaaattgctttgtgctcagcaaaaactcaacctgttaaattccagtgactggaatcattgaaggtcaagaggtaaaactcacctgctgtgccacattttcacaattcagagggttcttctgcactcagcatttatgtgatggtttctttctgtggaacatgtattccattttcaaaaggtctagtcttgattaacttgtacttggttaacaaacatgtattgagagtcatttgggttctgagcacagtattaagggatttggaaaagagaaggtaaaaaaaattgtatacagagaagtcaacttaaaatcctgaaatagcaacaaatataccaaccttgacattgtagtttataaatccattttagaaaaacaaacatattgcagagagaaaaaaacagaaatgatgatctataaaacaacatatattttaaattaagcaaactagaacatcatgaaaatttcatcgtatgggctttaatatgagaacaggaatgcaatcagtactgaaaaaaggtcaaaagaaaaatctaaaggttcatttaaagcatagagcagaaaattctctgaaaatgttttctctatatctaaaatgataaatttcatcaaatttgaaatttgggtaataaaaatggactattcaatgataacattttcaaaatactttataatgccttatttatattagatctttgttcttaagtaacatcatgacaaatacgtttttctaaaatatacagttataataaattaatggcaaaaagtatgaatattgtcatagttatgtcataacttattgtcataagttaagtgggctcagactgctgggccttttatatgtcaatttccagcatttttgtccactcatagtatttaatggttaatttgccattcactgtagcctactaagaactaaatagtgcaaaggaaaatcatgttgttaaatcaattacatgacaacttttaagaaaaattcacagtcaataggctcttttctgagagcctgtgggaggttctgtgagtcctctatagtttctatctgtccattactatgtgtccaatacctgccacatcactggcaaccaatttaattgataacacaatgataaataaataaagcatatatatttgtgacttttttcctatattatttcaaatcttccatttatttttaagtctatgtctgcttggaataggttaaactgccaaaagtttgaatgccaaagtaactgaggtgctagctatcatgtgcatttttgatatttcatactaaaattaaacaaattttctttgtaaatttcttttcattgaaaaaaaatatcatgggatgacaaagatgttttgttccagtatcaaattctctttctttgtctttatttgaactatagatgtgtatagcaaattcaactttgaatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaattcaactttgaataaaaaaagttatgttcttttttgcctcgctaagtattagtagcaaatattcaggtatagctaatattttcatgcatcaaacataaattagaaagaaatagtgttcagtataatcaacaggttcacaggaaaaaaagaaagaaaagaatggtgtttgattttacccatgtctggaaagacaacatcgtgttctggaaggctctctgatgggaagtcagaggtgcagaagtgcaggagagctgggaaacaggttgcaatatactgtgagatcctttagtttgtaaaacacaaaggctcagattgcagggaagatattaagcttcacatatttcatttgaagtgtttttacatttacctcctgtggtaaaatggccatagcatttcagggcaaacgtccttgatgtgaatgggagtcccagtgttgagtgctaccccacttctggcacacactgtatttgtttccgaagaatcaagcttgtgaggagagacaggacatacaacctagcatgtcccggggaagccgactttgtcatatatacacacacatatatatatatgaataatataaatgaatactcacctcccctaatgtgttcttttataagctaaaatttttatacaaagcaaaatctcatgggatgtcacttgaaagaaaaacatgttttatgaaatcaagatctctagaaaaaaagtaagtagacatcattaaaattgttctagtgatttttttcaaaatgatcagatatgccatttgataacatccccagaagttaagctattagaggatttcctgaaaaatgattaaatgttacccacttcaccaaggatataaatatcttacactttcaatcaatctttcacgcttttattaacaactcataattataattctttcagtgcttatgactctcccaacttgataaataaataaattgaatgtatctgccctgccctgaggtcaaaaatactggtgtgcacctcctcccttgtaagattcttgaacccacttaatgactctgcactctacatgtgggtcttaggagggactcatcatcatcactgaatggaccgtcaatgtggcaaaagctcaagatacttttggaagtcaatatttcgatactaaaaccaatatttaaaattgaaatataatttacataccataaaatttacccattgaaagtgtacaatatagtgctttttagtatatccataaggcattacaaacatcaccactatcgagttccagcacagttccatcaacccagaaagaaacaccctaggccgggcatggtggctctcgcctgtaatcccaacactttgggaggccgaggcaggcgtatcacttgagctcaggagtgcgagaccagcctggccaacatgatgaaaacccatctctactagaaatacaaaaattagctgggagtggtggcaggtgcctgtagtcccagctacttgggaggctgagtcaggagaatcgcttgaacctgggaggcagaggttgcagtgaaccgagattgcaccactccagcctgggtgacagagcaagatcctgtcaaaaaagaaagaaaaggaaggaaggaaagaaggaaggaagggagagaaagaaagggaaaggaaaggaagaaaagaaggaagggagggagggagggaaagaaagggaaaggaaaggaagaaaagcaggaaggaaggaagcaaaaagaaacataatccccattagcagtcactctgcactgcctctcccccagccctggcaatggctaatcaactttgtggctctgtggatttgcctattctgtacaccaacaccagttttgaaagagaatttttttcattagttcacttggatattttgtgctgctctattttctttcttaaaaaaaaaaaacatctagaggataaggaaaataaaactttgcagatttttgtcaaatactattcagtagaaggattattttcttaaggaaataaaaaatgaaacttagattcctgggcttagtctcttggaattcattatttcaattattttgttcatgctaccaaagaaaccttcttttttttttttttttttttttgaaacagagtctcgctctgtcacccaggctggagtgcagtgacacaatatcggcttattgcgacctccgcctcccagattcaagtgattctcctgcctcagcctcccgagtagctaagattacaggcgcacgcccccatgcccagctaatttttgtatttttcatagaaatgaggtttcactatgttggccaggctggtcttgaactcctgacctcagggaatctgcccacctcggcctcccagagtgctgggattacaggcatgagccactgtgcccggtctcaaataaaccttcttgaaaaaattatattctcataggaagcgcattagactaattatattttgtagataaataacactaaacatagcttacatataaaaatttctttgcttaagaattaaatgaaataattctctggaaaacattcaattactagatattttagcataattgctcaattttgtgaaagaatcaaatgcacatttgtccttaataatatgaagaatggaaattcagttttctaaactatctatattttaattaaaagaaattcactctctttgtaataagataataatgcggtattaaaataaaagcattctcaatagtaaaatgtttttgctgactagctttgttaataaaactatgttttgaacaatcactggattaatcctagtgacaatgtgtagagttttcaaaacaggaacattaacagactcttgtcccatagtcttggtacaatggtaggagcctggcttaaggtagatgggctagagagaaagagagggaaataggagattgtaatgaaatagagccaaccaaacgtgttaaattttacacaggagatgaggaaaacttcaagatggtgccataatttcttgcttgagtgactgcccgtggaagacagaatttatcaacatagaagatggggaggaattaagatcttttcttactgaaaagatcctaagtttggagcgttttgccctgtagctatttaactctcaaccaggtatttggatatacaagtttattgttcagagtaatagaagctagagaaaaatattggaaatggtcagtataaaacttgtggatagcagaaattctggttgaaatcacccaaagtgtttaaagaaaatagaaggtggttaaggacaaaactgatagaaagagaaggaaggaagggaaggacaaatggagacctgaaagtttctgaacaaaacagggaaatcggagaaaacccaaaagactgatgtggcaaaaaccaaagaactcaagttttaaaacagagcactggttaacagaaatgaatgaagcagaaatattcaatataagcaggactgagaggtgaatattggaattgcctatctggatatcactagaagaaaggtttcagcagcaagggagatgctaagccagcagttagacgcttgaggccaatgctgctaagctgaaaatgtgcacttagaactgattagtatgtagacagtatttggagccattaaatcagtgtgagatgacttggggatgagtgtgggtaaagagaagagaacctagaactaagaaagagacagagggggaaccagcaaactgagaaggagaggccagggagacgagagggacaccaacagcttgtggggccctgataggctttatgaacttgagtcaaagaggaccgggtggtcggctgtgtgaagtgctgccaccagatgagatgggcagttccactggaattcatactgcggaggttattggccatgctagggaaatgcctaacaggagccactcaaaaacatgtcaaagtcaacaaaggtaaagaaagcctaaggaatggttccagattaaaggctactaacaggacatgataattacatgtgacatatgaccctggactgcattgagatcactggcaaaatgtgaatgtagactacatattggatagtaatgtggtatcaatgtttagttttctgattttgataactttactgcagttatgagagagaatactctttttcttcggaaatatacaataatgtgcttcagaataaggggcatggcgtctccaactcactctcaaattactcaggaagaacgaagtgtgtgtgtgtgtgtgtgtgtgtgtgtgtgtgcatgtatggatagataatagaataataaagtaactagagcaaaacataaacaaatgatgagtctgaatataagctatagaatagtttcttgtactattattttaacttttatgtataatggaatgtagattttagaaattacagaaagaaaatgaggagagggagaaaaagggggagagcaattggaaaaagcaagtctaccaactctcgtaaaataaacacctgcgctctagagaaaagtaaggaaatggggtgggaaatggtggggaaggtaacatcaaaacaagattagggtttttttctccttacctgaccaaaattacagcacagtggcaagctgatgtcaatatgccagtggaaagagaaaaaaggttgaatagcagagaaataggggaaattgctggcatgatttcctttcatgaggagaagagggtgagtctgcatacaaatggagaaactggctctcctaggagtagggaacattcatctttggtaataagcagaaaaacaaagcatgagaatgcaattactggaaggtagaaaaaagagataaagagtgcctaccccactttttgccctgggggacctggaaagcacctcccttgaatggattcgtgggaagtagtgtttccaagggacaaccaggtttcagtctgagcaataaggtgaaaggaaagttcagagaatatcctaacaaatggcagagcttgcatttaagaagctatatacggagacacatggaaaatccagccatggtagtggatatacagatagcacaaggttgagggcctgcgtcatgatggatggcctgtgtttgaaatgctttttccttggtgtcataaagaaacagcacttgaacataaatttaattttctcagcaaggccatttcatactttctgcagaaagggtacagcagcagcagttttgccacaacggcacaccgaacaaaccggagacagggtcatttataacctgatgcatccaccctactgctgtgtccggtttccattggctggaatggggcctcacattctgtatttgtcctgattggctagtaacttagaaaatttttaaaaagacaaaggcagaggagaacaaaggaaggaggaagtaacttgtggcatgctgagaaaggtaaaaacaccttcaaataaggaagaggaacaggctatggcctaatgcttgcttggaccagtataagcatgccagggcaaatatttaggctaaactgtgggagctaagaacataaagtacattgatttctttattatggatagcagatatttaagaatgttagcacaggtctatgaataaattttgcttctaagagaagttactatgtattcctaattagatggggaggaaagtctttgaagaggaacctctactttactttttacacctgggacctggtttctgggtgaatgagggaatgaaggatgtgagcataatgagctcagtgctgattatttcctgaagagaagtgggcaaccagttcaagacagatgttatgggtccactggctgaccatgctttcctgcagaagccagtattacggcaaccaaggggagaaagagagtctccataacaattaatcttcctggaagctgaagcaccaaatggtttgagtgtttcttcttcttaaagggaaggtagtgtggcccatatgaaaagggtggcccattgtgaagcaggaggctagaaatgggctcttctttgtgggatgaactgtatagcagctggtgtgggagctggagcataagtggcttagaggcagcttcttctctccagcagcgggcaggttggctctgggatcacctcagtcaatggcgtcaccatccaattcaaagataaggatggaagcagttataagtatgtttgtacaggcttaattttctctggaaagtaggaatgggtcacctgaggataaaagggggaagtgaataaagtcgggggacagaacatctgaggtctcaagggggattcatgagattttggatcaagccactgagggcacatcaaaggttcatggacgaagacatggaagaattatagaacagggcccagggcccacccagtgttggagtttacaaatcagtcactacatagtggtcctggatctgttgaatagtagactcttcaaaacacactgataaatccctccctcttaaaagctgaagaattggccctctctgaaaaccacagcactgtctcgcattatagggattaacccaaactgctctgtgaagctcgtctaatctatgagcaatgagaaaggcagaagaatttgtaataataaagaaatgaaaactgagctgtagccttcgattacactgtgacatttggtgagttcactgtctttctttagtgtaagaatcaaggaacaaatttgttttattgtttggcgtattatataactcatttgacagtactgcttaagttatacaacaacccctaattcatatttttaagctcgtttgaaaaaaaaattaaaatgctctcaccttggagcattactttacattttgcagcacacatttgtagtttgggttctttttaggcagaaatctgaactaacaagtacttctattttttctccagattctttacatttctacagctttatttcacccttttctaacataataaaccatttctcagcaaacatttagataaaatgtcacagacttggagaaagaaaatctaaattgcagatcaaaaacaaggccatattaagcatgagaagtggtagtgggaatacaatttacaatgttttgatttaataccataaagaatgtccacagaatagactgcaggttggaattcgtggagatgtcttctttagtttatgtaatgaatgccattcttattcagtaagatttaatcaggctacttgagactgagatataagtgtagagaagatattggctttccttctccatatacttggaatgtaaaattacttaggaaattttacactgacactacatggtgaggagatatatatatcttaaatatatatatatatatttctttttaagattaagtatgagacctcaaaaatatttggactgcaaatactattttaaagtaataaaatattatttctgtgaaatagaaactaaaattgaaaagtgcttgaagtataaattctattaaattttagtgaaaaaatatcaagaaaatactcatcatataattaaaaatttattgtgtacaaatgggttctgctatttctaatatattttattatcaatgtattatattctgttatataactttatgatattcatttaatttcaagtactagattttgatatactactttaccatattttggtttctatttccttttatagacaggttcactccctaccactaaaaatgtttaaatacttaatttaatctgagacaacatctgcaacaaaaaaacagaactgctgttgtaagtttctgatattatatgtaaaatggcataacaatataattttatttgaaggtagactgtgttaacttaaatatatatattatcaatcctagagtaaccactttaaatataaagcagcatagctaatgagctaaaagaagacataaaacagaacactagaagataaccaattgaaactaaagcagaaaataaagagggttgaatgaagagaagatggcacacacagaaaacaaatagcaggatagtagatttatacgcagccataccaataatcacagcagatgtaaatcatctaatatttcaattaatagtcagaaattgacttccaatttctagtccggcataaaaggaacctgaaaatcatcactgtctcctaaccataagtaaaaagctgaaaaacttgataatcaacaagtcttctacatctatcagagaagtgagctcataggacaaactgcagccctcaaaactgaagagacactagtggatacagacaggtcccactcaccagagcagaaacctcatgggaacgaatactaggctaggaaaacctgaactgtaatctatacattgcacgaaacctcatgggaacgaatactaggctaggaaaacctgaactgtaatctatacattgcacgaaacctcatgggaatgaatactaggctaggaaaacctgaactgtaatctatacattgcgtgaaacctcatgggaatgaatactaggctacgaaaacctgaactgtaatctatacattgtgggaaacctcatgggaacgaatactaggctacaaaaacctgaactgtaatctatacattgcgcgaaacctcatgggagcgaatactaggctaggaaaacctgaactgtaatctgtacattgctacaggcttgatttggacaattctgagagttaaaatcggggtggggcagttttagggggacctccacacttttgagttttacctctagcagcaccaccagagtctcatagtgaaggttagagaagaagtctgtcttagtctgtctggactactataacaaaatactttgaactgggtgatttataaacaataaaaattgttcactcggaggctgggaagtgcaagaacgaagtgtgggcagatccagtgtctgatgaggacttgctctctgctttgaaaatggagccttctttctccatctccacatggtggaagggcaaaaggactccctcaagctgtataaggatattaatcctatttatgaagacaagccctcatgaccttattacctcctagaggccccaactccgtaccattagtattagatttcaacacacaaattttgggggttcagagagattcaacaatagcaaaactcctcatgcttttgacagagagagtagaaaaataactactttgaaatatgcccggagcattctgctctttttaacaaggcgtgccctcaaaaggacgtattttaccacagctagccccatctggcctttgacatggagtgaaaaaaaatacacaacttcagactgctctggccatcctgtcccacctaagtggaaagaagagagagactccaaagcatttgcgaaggtcacagcacaggaacacaagctcattaaaagactggaacctaatcatcggactacaggacactttccctcccactccaccttcccgccacatcactaatgacctatctaccacagttccttctacctgcatgttcagctttcaacaaaagttacaatgcacattaaaaagtagaaaacaggccaggcgtggtggctcatgcctgtaatcccagcactttgggaggctgaggtgggcgtatcacaaggtcaggagttcgagaccagcctggccaacacggtgaaaccccatctctactaaaaatacaaaaaaaaattagctaggtgtggtggtgtgcacctgtaatcccagctactcaggaggctgaggcaggagaatcgcttgaacctgggaggcggaagttgcagtgagccaagattgtgccactgcactccagcctggggacatagcgagactccatctcaaaaaaaaaaaaaaaaaaaaaaagtagaaaacacaatctgaagagacaaaacaagcaccagaacaaggctcagatatggcagggatgttggaaagttagagattgtcagactggataaaaaacaaatcttaaatccatgctgtgtgcaataaactaattttaaatagaatgatacatataggttaaaaataaaaagaaagaaatatcatgcaaacactaatcaaaaaaggtggagtggctatagtagcatcagagtaaacttaaagacaagaaatactactagaggtaaagaggaatattccataataaagaagtcaattcatcaagaaactataacaatcctaaatgtgcatgcatctaataacaaaacttcaaaatcataaaacaaaaacaattgaaaggaaaaatagacaaaaatccatatttacattggatagtttaacactgttctctccacaactggtagaactagtgaactatattcactaagaatatagaaaatgtgaacattatcaatcaacacatcttgactgatatttgtacaaaataacacctaacaacagcatactgcacactattcacatgtgctgtggaatattcacaaagacagatcatttgctgatccatgaaataagtcttgagaaatttaaaagaattgaaatcacttcagaataggttctctcaccacaaatgaattaaactagaaatcaataatgaaaaaaatatctgggaagccccaaactatttggaaattaagcaatatggttacaaataaccaagcaccaaagaagaaattaccagagaagtcagaaaatactttaaccaatgtagcagtgaaaacttaacatactgaaatatatggatgtcagttaagcaatgcaatgctgagagggaagcttgatctccatatggttatattaagcaccgtgaaaacaaataactataatatactaaaacagtatttattgtttttgtttgtttgtttgtttttttggcgacagagtctcattctgtcgcccaggccggaatgcacatggcagcaatctcggctcactgcaacctccgcctcccaagttcaagcaattctcctgcctcagcctcccgagtagctgggattacaagcacccaccaccatacctggctaatttttgtatttttagtagagatggggttttgccatgttggccagtctggtctcaaactcctgacctcagatgattcacccacctcggcctccaaagtgctgggattccaggcatgaaccacagcacccagcctaaaacagtattttttgttaatgagggaccatttaaaccttctctacttggaaggggcagggaatgaaggacaggtatgaggctcaacacagtaaaacctagggacgggggcgacatttaggctggacattgaaaaatgaagccagatgaggaatttctgtgaggcaggagcatgaggaaaggcagggcatgctgtccctgagatgctgtggatagaagaggtgtcattccagtgtggccggagggtaagatttctggaggaaagtgagcggggccgagaacatcaagctgagcgcgcaacagattgtgaagggcctcgtatgctctacatgtacatagaagtaaatgtgtgagtcagaattccttctgtggacatactcaacaatattctctttttgcttctctaaaggaaaaataactgactaatgcaacagtcagctcaatatgaatcataactattgaaaaagagaaagaagtttgatgaataccaaaattaacagaggcttttccatatgtatcctttgggtagcttcccagaaggaagaatcaacacagctacttggcaggtctacctaagctagccccagtcacacttcttcacaaactccagctggcatgcaaagtgtgagaaaacagcccagctaaaacacagtactgaaaagtcttgaatttacaaacaaaagattgctattaaataaagaaaatagaaaacaaaacacagcactgtgttgtgactgtgaggaatacttttgcaccagaagatataaaatgtgattaaacaggcgttgattgatttgggttcggtgggtcaaggcctctccctggatttgaacatttcagagtccagactactgactggctgtaatatcaaaacactgtataaaatgcttcgatttgtaacagaatttaacactgtcagaagtcataaggcagttttgtttttcctaattcacaattaagttataatagcagcaagctgactttactcagtcacagagccagaggatttgatgaggtgtacaattttccctcaaggataaaaatgtaattatgaaaaagtcctgaactgaaaaacagtattgtcagctatttccaagaaagataaaagatcatttaaaggtaaagagattacagataaaaggaatacaaaattaagttgaaaccaccagggtagagagaacaagttctaaacaagaaccaaacattaaaacattttattataacaagaaaatatggctttcgtttttctaaaaggacaataagtttttaaattcatgtctgattagttcatccagatgtttaaagataaatagatatcaattgatgattatactttccatgttgctgataaatagatatcaattgatgattatactttccatgttgctgataaatagatatcaattgatgattatactttccatgttgctgataaatagatatcaattgatgatgatacttttcatgttgctgataaatagatatcagttgatgatactttccatgttgctgataaatagatatcaattgatgatgatactttccatgttgctgataaatagatatcaattgatgatgatactttccatgttgctgataaatagatatcaattgatgatactttccatgttgctgataaatagatatcaattgatgatgatactttccatgttgctgataaatagatatcaattgatgatgatactttccatgttgctgataaatagatatcaattgatgatgatactttccatgttgctgataaatagatatcaattgatgattatacttttcatgttgctgaagaagcgaaccctgaatgtgcctcagtctgtcaaactgacagtcagagggaggccctagtcagagggaggccctattctacactcagtaaccaggggactccttttcataagttcatgtaaactgcaaggggtacttaatagttttgttttcatttcttaccccaaaacctatctcccactaagccctctctataaaatgaaaaaattaatatctgtttcaacaggattgctgggaagatcaaggaagagaaaatgaataatatatgtaagagaactttgcacactacatagccctacacagaacgcattattaccaagtattttacatttataaagtgcttttcaaagcactctccacttaaaattcaattcacaatcaccagctaaggctgaagattcagacacaaaatccccgcctgcatgaagctcatgttctggactctagaggaatcaggtaatcctgtctatacctgtggaaaatgctgtgaaaacataggatgttgctacaaagaagttggcgtccaaattagagaaatgagtgcatcgctcctgttctcaggactctggatttctgcaaccttcttaaaatctttaatgaatatttgaaattatctcattgcacctgttatcaatcctctgataggaaccaagagagatatatgttatttctgagaaaagtgaggcttcgaaaagataaacaacctcattgtgattcaatgacttgacgttcagctcacagtctagaaaatggctaagtggcaaaactggtcttcagactcaagaaatgttcagtattatacaatagagtgcatttggtgtttgcagtcatggaaatggaatgtggggtcttattggaaataagctactccataccagacacgtattttaaaagaagaaatcatgattcttagaaaatcgggtgtcatgactatacatttaaaattctgtcaaaatcagtaaaacaaagtaaacagccaatgtgtatgcaaatgctttacatgaatagactatctagtctcaaatccaatagctgttccgggaggaaaaaatctcaatttgtttgccgtgagaatgtcaaactgatatttctgtaacagttagcatggccacagtgctccacagagagtgcaaagatcctgcatactgggtggccaatatgggtttaaaaaagaaggaatttttattgccctctccccaacaatactgtgcgtgcacacacacacagacacacacacacacacacacacacacacaatgcagcagcaacaacaggtgcagggaaaggttccagcaaccctttctctgctcctcagggaggatattctggagccttttcaaaggctcttccagagctgattgagaaggttttcttcgtcaataaacagaggtcaaggaatgcctctttgccatggagtctggtcaaagttaagtgtcccacttgtggacaggaacggaggtaggagctggatgcctgtcgaaaacaaactaaattccagaaaataatcttagtgttcaacaagaaagaaatgttttcaataaatttgtgttcatttacaagactggaaaactgtttaaagtagactacaagattggtgataattacttaaataagcatttatggaaaattgttgttttatatatttttataaattttatatttatataatatgaaaattcatattatatatttaaatattgtcatatatttaaaattcatatatattttaaaattaaatattaaaaattaaattatatatttacatttaaatattaaacctattaaaattggcattgaatttcttatatatgtcatgtatattatatatttaaaattatatattatatattatatatttataaaaatatattttttattttttataaattttatatttttataatttgaaaattcatgttatatatttacatattaaatatattaaaattggcattgaatttattatatatgtcaggaaaacaatgacaaagaaatacagcaacgttagcaatcagttttttttctcatacttttttttaacttttattgtgggtttgggggtgcgtgtgcagtttcgtgataaaggtaaactggtatcacgggggtttgttgtacacattatttagtcatccaggtactaagcctgatacccaaatagttattttttctgctcctctccctcctcccaacctccaccctcaaggaggccccagtgtgtgtgttgttcccttctttgtgtccatgagttctcatcatttagttcccacttataagtgaaaacacgcagcatttggttttctgttcctgcattagtttgctaagtaatggcttccagctccatccatgttcctgcaaaaatggacatgatctcattctttttaatgactgcaagcaatcagttttaagcatggtccagtattaaccacaatgaatatttcttccatattaataataaaaaatgtaaaataaaaaataatttccctattaaagataaaaaattggaaataggtattaaccttcctctcaagtctcaataaaaataacaataaaaataacaaaaagtgttctgttttgttttattttaagttgtaaacccataagagcagaaatatcaacagaggaaacaataacaacaaaataatgggggtggaaagcaaacaaatgagcaatcatggactaagagaccagttcaagcataaatcaaggctggcgatgggaaagcagagaagcaacatggtttacagcagaaaacccacagagcctcagaaacgagcagcaacagaaaaacaggctgttaaggaagcaggtcaacagctcccctaccgtggtcctcatttccacaccatcctgcatgccatggaacgatccgtcctccaccctggagaagcttagagcttattctgtggaatgggagaaacggagagtccctgtaatggagataccaagaaggagaggcgggtcatatactggaaacaagagaagcaaagttgatgtaaggaatattgagactacaactggatctttccttctgtggctcctaaaatgcaggtggcagagttgtaccttccatgcaggaaataagagggtttttctagggaattgagaggatctccagatagctgggcctatttaaatgagagtgaagcccaagctgatgtgaagcttgcacctagaatttccaatcaatcttctagggcctcactcttaaatataagcagacagctaaggatcaccatcctttgataggattaagaatgagcaaacactggaaacatactgaaatacagccggctgtctaaaacagaagatatagaatataatgaaagaccaaaatggatatgtgtagagattacacagggaagatagtggaattgacaactctggcagcaacgctgctaaggacaggatgaatatgaaaattgcttgaagttcaacaataaggagaaaggaggttgccaaaaagaccaggagaggcaagaacaaggcctgtcataaggttatagtgcatgaatggcctatcggttaagaattaattcagcagaacataattgaaaatacattttaaaggagcatgaataatatttgtattttctctataacaaggcaggttagttcaaatgcatcatgacgtcttcaggaacccacacttgtctctctttattgaacccacactcttctctttctattgatcccacactcctctctctattgaacccacactcttctctctgtctctcttttgttttgtttttgttttttgagacagagtcttgctctgtcatccaggctggagtgtagtggtgcaatcttggctcactgcaacctctgtctcccaggttcaagtgattctcctgcctcagcctcttcagtagctgggattacagccgcccgccaccacacccggctaagttttgtatttttaatagataccgtgtttaatttcaccatgttgaccaggctggtcttgaactcctgacctcaggtgatccgcctgccttggcctcccaaaatgctgagattacaggcatgagccactgtgaccagcctcttttctctctattaaacccacaatcttctctctctgttgaacccacactcttctgactctattaaacccacattcttctctctcaactgactcacactcttctctctctattgaacctacgctcttctgtctctattgaacccacactctcctctctctatggaacccacacttctctctctattgaatccatgctcttctctctctcctgaacccacacttttctctctctattgaacccacactcttctctctctattgcatcaggcttctcctgcgccttttcgtctcatgacttttcacctcattgttgaacagtgtctgctttaccttcaagttctgggtaggaagaagagcaaagagaaaaaggcaagaagtagttgccagtgtccatatctcttttaagagctctcctagaagccctacctagtgacttctgattatataatagcttcaaggagtatgtgggatttggtggttgttttaagctggactcattaccactgtgaaaaaaaatcacattgtatatttaagaaagaaagagcaaatgtatattacatagagaaccagcagcatacatcgctgattatttttgaaaattaaaatgttttagtaatgggcttgaaattcaattccagtcatcaataaattaaatgtatacaatgaagaagacttgtaatttaacaatcattctgggttgcttagtgggtgtgcaataatgacctttgaagaggggaacaggccgggcacggtggctcatgcctgtaatcccagaactttcggaggccaaggcaggcagaccatttgagatcaggagttcaataccagcttggctaacatggtgaaactccatgtctactaaaaatacaaaaaattagccgggcatggtagtgcacgactgtagttccagctaatcctgctgaggcaggataattgcttgaacccaggaggtggaggttgccgtgagctgcaattgcatcactgtgctccaggctgggcaacagagtgagtgagactccatctcaaatttttttttttaaaaaagaagggaacaaacaaaggaaatttctgggagagagaaaaatggaaaatgagtagctgtctcccttctttcaggtaactgctttcaggtcctccagaatttttattaatataaaacaacatttgcattatcctatcaatattgtagtttgtgacagtaagtcaaaatatacttttcactgggcaaaggacatgaacagacacttttcaaaagaagacatttatgtgtccaacaaacgtgaaaaaaagctcaacctcactggtcattagagaaatgcaaatcaaaactacaatgagataccatctcatgcgagtcaaagtgatgattattaaaaagtcacgaagtaacagatgctggcaaggctgtggagaaataggaacacttttacactgttggtgggagtgagtgtaaatttgttcaaccattgtggaagacagtgtggtgattcctcaaagacctggaaccagaaataccatttgacccagcaattccattacgggctgtatacccaaagtaatataaatcattctattataaagatacacgcatgcttatgttcattgcagcactattcacaatagcatatatatggaatcaacccaagtgcccatcagtgatagactggataaagaaaatgtggtacatatacaccatggaattctatgcaggcataaaaaggaacgagattatgtactttgcaggaagaacatgggtgaaactggaagccattatcctcagcaaactaacacaggaacagaaaaccaaagactgcattttcacacttataagtgggagctgaacaatgagaacatatggacacagggagtggagcaacacacactggggcctgttgggggcacaaggggagggagagcattaggataaatagcgaatgaatccggggcttaatacataggtgttgagttgataggtgcagcaaaccaccatggcacacgtttacctgtgtaacaaacctgcacatcctgcacatatatcccggaatttaaaataaaataaaataaaaatttaggtatatatatatatatatatatgtatacacacacacacacactttttacttggtgtatctaggaaatatacaaaagcttaacaataaactacccaagaatcaataaaaactaaaagttaaatataaaaaatgcctttccattgcataaaaatgtaatttcaccagcccaatgtatgtatcacttgaaaaaatgtcgttgcaaaatgcaatctcttttgtgctttatactgttgattttaaaatttaaagtcaggagagcaaagcacatataaattggttccttcttttatttctcaagaagtcactctttctttttcattaccatctgctctgactgctattacaatttttatcccaaaaggtgatgctgacagtgtaaaggtggtataattaacaaaattcttctctcatgacatttctcacagaaaactggaagcaagaaaatataattgcaccagcagatatgtttcaaaaccaagtaaagagcttatgaaaaataagaactcttaaatgcaagcactacagattgcctagatcaagacaatatccatgaattgaataggttttccagataataaattgatagaatgcagcacatatctccatttcttaagagagaaaaattttgtgtcaacatgtagatgcacagcatggtctgacattgggactgaattattctcagttaatcaatagcacgcatgtgaagtagccattcacagactcggctgctcactggcatgacctggacgacatttccctttacagattccttgacccactcccaagggtttggattcaatagggtttgggttgctctgggacctgtagttctttaaagccctcttgatgactgattaacaccaaggagaagattgacaaaaatctgtaatagcggaagcatttactacaagtaaaactccgtgtttaaacttgggggaaaggagtttatccttacgtagcttattatctagcacagtgattctcagctgagaataaatttgcctcctggggggcatttggcaatgtctggagactttttttttttttgagctggagtctggctctgtcgcccaggctggagtgcggtggcgcgatctcggctccctgcaagctccacctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgagcccggccgtctggagacattttaggttgtcactattgtggggtggagggtgggggtggggaggcggtcctactggcatctaatggtagagaccagggatgctgctgaacatcccacagtgcacagggccgtcctccaccaccaagaattacctggctcaaaaggtcaataccggcaagagaaaccctgatcccaatagggggaataagaaaatacattaaactatataatgaatggtgtagagatttaaaagttattgcaaagatatagatagatgctatcacaattcggagcagggtgagttagggccagcagagaaaggatcttaggctctggaatgaagtctatgcctcttcctacagccttactacttaagtgttcaacactagcggaacacttgcagtttcgagcatttgtgcatatggtaattaagctaaataaagttcctgttctccttgaaggtcacattctagttggaagaatcaggcagaacatccaaagtttaaaaaatggaaaaaacaagtgttggcaagcatgtggaggaagtaaatggaacacccatttctagtgagagtgacattggttcaaccactttaggaaactggctagcagtatctaccaaagctgatctacatgccctgtgattcaacacttctacccctaggtgtttgtttaacagcagtgcatgtgtatctgtgccaaaagacatgtacaagaatgctcatagtagtagcatgtgtaacagtccaaaactaggtacaattaaaatgtccattaggccgggcgtggtggctcacgcctgtaatcccaacactttgggaggccaagccggctggatcatgaggtcaggagatcgagaccagtcgggtcaacatagtgaaacaccatctctactaaaaatacaaaaaaattagctgagtgtggtggtgggtgcctgtaatcccagccactcaggaggctgaggcaggagaattgggtgaacccaggaggcagaggttgcagtgagccgagatcatgccgttgcactccagcctgggtggcagtgtgaaactctgtctcaaaaaaaaaaaaaaaaaaaactctattaataaaatgaatttttaaaaccaaggtgtatttttgtgtatacaatggaatactatatgcaattcagctgaatgtagtactgctacacaaaaatatgtagatttatctcacaaatgtaacattgagtgaaagatgtcagatatgaaaattatatatggtatgatcccattatataaaaattatatagagataaaattaatgtattatgaatcaaaacagttgttgtatcggaggaagattatgagtggggtctttctggaagtcatctgggtgctgtaatattcaatttcttgatctgagtagcagatctggtaatccatattgtctttgcttttttctgaataccacattttgataaaaatatttacttaatagagcaatgacaagtgctatgaagaaaagtaaagctgggtaagggacttagagagtggcaggtcagtgtcatagatattatttatagcagagatccacaagctttttctgtaaagggccagatagtaaatattctaggctttatgagcctacaatctgtttcacaatcattcaactctgcggttgtactgcaaaagcagaaatagacaataagtaaatgagtgaatgtgactatgttccagtgaaagtttatttgtggacactgaaaattgaatttcctaattttcatgtgttgcaaactactatttttgctttcgattttttccccagtcacttgaaattataaaaaatatccttagctcacaggccataaaaaaacaggcattgggtgaatttgacctgtgggccatagtctgcaacctctgaggtagaggctagtgggagaaagcctgcccaaggaggtaactttgcacagtcctaagcaaattgagatagcaagtaatgtattgatccagggaaggcgttttctctggggaggggagaggaagtaggaaggccatacggtggaagcttgctgagtgtgttcaaggaacagcttctgtggctagagaaaaatgagtaaatggcgacactggcagcaacaagccatggcccgagaggctcagagagagatgctctaaaacggagagctggtggcgatgaggaaggtgaaacagagggaagaaatcctggagcaaggatgcaagccagaagtctgaatctctcagagaagaccggagacagaactagcatgtggaatggggtggagaggaggaggaggcagggaggcagtcaagtgtctttccgtgcccaagctgcacaccacgcacaccaccaccaccgcacagacacacctcagagttatttagttcaagcattgtaagactggataaaggtgtatttctttctgtctctttttttctttactttctttcctcccttttttgtttttttcccagagaattcacatcaaacagcattatttataatgatgatgtccttctaggtaaactcagattttccaggtgaaagagaatggcaaccaacagtggcagcgattttttaaatgcgacatgttggccgggtgcggtggctcacgcctgtaatcccagcagtttgggaggccgaggcgggcggatcacctgaggtcgggagttcgagaccagcctgaccaacatggagaaaccccatctctactaaaaagacaaaattatctgggcgtggtggcgggcgcctgtaatcccagctacttgggaggccgaggcaggcgaatcacttgaacccgggaggcggaggttgcggtgagccgagatcgcgccactgcactcgagcctgggcaacaagagcgaaactccgtctcaaaaaaaaaaaaaaaagagacatgtcttcaggcttattgatgtatctgcccctggctggaagatttctcgaagctccaacataaagtaggacctaatgtctggcactgcggttgaaggaatgatttgcctactgggtgttttacttagcaacaactcagctttttatggaattccagttctccaatgtttgttctctgatgtattgttgcctcttttataacagtcattaaacactgaaaatgtctgatgcggcaaaacttaatggacacttactggttataatggaatgaagagtgaggtggaaaaaaaaagatgattacccaaagctttcataaaatttcttgttatcttttcacatcttttatacagacaatttatcttgggtaataggctatgcccttttgatctacagactagaaacacaagaattgtaatagcataatgttgtatcaggtatgccaaatacaatattttacctaatttcttgtattactttgcttcataggtcagggaaaagaaaacacatttaaagcaaccattaagataagaggacagatgcaaatttaaaatagttgaatttaggtaaacagaattaattaaacccttaatttcattagtatttacagagtgcctgccatgtgtcagacactgcctagattctaaatgactaaatgcataaatgagtctgtatagataaataaggcaggttaatataaataaatgaaattatatagtacctatctcataataactgcttaataaatgtcagcaacaaatattgttataaaactgctatgggatcttcacatttggtataattatgttaactacacgtatgaaaataagagtcattaatacgaaggcaactgtactaggggtagcatctcatggtgatgataagcatctgtgactagccaaaaagtgcttaatcaccccaaaaggcactctatgatgttggctaaataaatatcaacaacaaaaggcgtttctcaaattagttctagataagttgcatgtcacctgattctatgactatcggtcccattggtattctaatttcttttttcaaggatctttcctaaaaaatattattgatgccatcattttgacaaaaacttgttaaagtattattaaaactggcataattgaaatttatttttgtgattaagattgaaaattaaaaaggcacaaaatagtagcaaatataacttgttctcattatattgtttatgacaataaattccctggttaagcttacacatggttctctcttctaactctgttttcagttccttgtaaaagattattctttgaagctgacatttcttgtctcttatctataacaaaggttaataggtatattaaaatgcagagaaaacattcacattttctcctagaattaaagttttaaaaaagttcaagttttatataaatgtttggaaatgaattataggtagctacaggcaagacatgttgtcaaataaataccttcagataaatgttgaaaaagctatttctaatgtgaagttttaaatatgcttggaacataattggttagacactgagcagaatgaaaaatctaattatcagcaaagggaggagtctatccacaaagatgtaagaaatattttaaacttagaaatcaaaacgttctggagttttttagtcaaacttcctactgttgaacttaaatatgcagaaagtcattttatctatctaagtgagatgtggaccaagattaaaagagtattaaatactaaatatttcttccttttatcttttattaaagttaaatagaagtaagatgtgcttacggatgccaagagaaaatataatacaacagagattcctcgtgcagcaccatcagaatgtcatcacagtaggccatgtcagtctccacttaactttcacacattctgatggacaatatccataagtttgtaaaatgactgtttacaaagtatactctgttctacttttctcaatttaatgctgtgtttatctgcctgggtgttttctttttttcctctctctgtgtgtgtatacatgtgtgtgttgatagtgagcagaacatagccaggagcagcaaactgtttttggagaagaactcatttttaatttaaatgtgggctttatagacaagaataagaagctctgattgcagctaatttcagcaaattaaaaagagcctgcggggaaaactgactggtaatgatgaaatgcaatcaagtgagcaacagtatcgatcttcaaacacaaagctgagcagataataaaatacagtttgaaaaaaaccattcatttttattataggatatagcagatgctggtttaagtactagaataaaacaaaaagcctattgattattacagcttgtactgacaacattgtatatacatagctggcatcgtttgtagcagtttgctcgtgtcctcaggcagggtactaacccagaatgggcacccagccactttcttctgaacagaatctcatgcattaaatatttatgtttcagtgagtaaggaaaagagaaggaaatcaaacattcctcctgcgtgtgcgtggaacttttgtcgaactataaacacagcatgagcacaaacccttctactacgcccttcaatacttcccttgtctttgtttgattggcaaaatgtctcctagcaaggagtttctgaattaggccaaaacaaagacttgaaataaatgttatcttaactcttaaacagaaatattatttttaggattacttcttacagcagagcagaagcttgtttagtagagaaaaggatgctgtcagattctcagggtttagaagcaggactttagacagaaggtagaactatttagacagaggaagtataaagggttctaaaatgaatgggaatgaggcagggtgatttcaagaaaaaaatactgaacttatccctagagaatataagcattttcattccttccttcctttcattccttccttcctttactcattcattcaaaaaattgtatagattcccagtagaggcataaccaggctggaaccttcaaagtcagaagtctggcagggcctgggtcactgttggtgagagaccactcttctgtcttcttgacatgttcctggccttgtttccacactgtttcctgttacaacctttcatcaaaatcttttttttattatttttttattaccataggttattgggaaacaggtggtgcttggctacatgagtaagttctttagtggtgatttgtgagattctggtgcacccatcacccaagcagtatatacactgcacaaaatttgttgtctttaatcccccatccccttcccacactttccctctgaatccccaaagtccattgtgtcattcttatgccttttcatcctcatagtttagctcccacttatgagtgagaatatatgatgtttggttttccattcctgaattactattacttagaatagtagtctctaatcttattcaggtctctgtgaatgccattaattcattcctttttatggctgaataatattccattgcatatatatactacagtttacttttccactcgttgattgatgggcatttcggttggttccacgtttttgcacttgcaaattgtgctgctataaatgtgcatgtccaagtatctttttcatataatgacttcgtttcctctgggtagacagcaactagtgaaattattggatcaaatggtagttctacttttagttctttaaggaatctacacattgtttttcatagtggttgtactagtttacattcccaccagcagtgtagaagtgttccctgttcaccacatccatgccaacatctgtcatttttttgattttttgattatggccattcttgcaggagtaaggtggtatcacattgtggttttgatttgcattgccctgatcattagtacattttttcatgtgtttgttggccatttgtagatcttcttttgagaattgtctgttcatgtccttggcccactttttgatgggactgttttttcttgctaatttgtttgagttcattgtagattctggatattagtcctttgtcagatgtatagattgtgaagattttctcccattctttgggttgtctgtttattctgctgactgttctttttgctgtgcaaaagctctttagttcaattaagtcccagctatttataattatataattattataattgtttttattacatttgcttttaagttcttggtcttgaaatccttgcctaagccagtgtctagagaggtttctccaatgttatcttctagaatttttatagtttcagggcatagatttaagtccttgatccatgttcagttgatttttgtataaggtgagagatgaggatccagtttcattctcctacctgtggctagccaattatcccagcaccattttgttgaatagtgtgtcctttccccattttatgtttttgtttgctttgtcaaagatcagttggctgtaaatatttgggtttatttctgggttctctattctgttccattggtctatgtgcctattgttataccagtaccatgctgtttcagtgactatggccttatagtatagtttgaaatcaggtagtgtgatgcctccaggtttgttctttttgcttagtcttgctttgactatgtgggctctttttttggttccatatgaattttaggtttttttttctagttctgtgaagaatgatgttggtattttgatgggaattgcgttgaatttgtagattgcttttagcagtatggttattttcacaatattgattctacccatccatgagcatgggatgtgtttccatttgttggtgtcatctatgatttctttcagcagtgttttgtagttttccttgtagaggtccatcacctccttggttaggtatattcctaagtattttattgttttttgcagctattgtaaaaagggttgagttcttgatttgattctctgcttgttcgttgttggtgtatagaaaagctactgatttgcatacattaaccttgtatccagaaacttcgctaaattattttatcagttctaggagctttctggagaagtctttagggttttctaggtaaacaatcatatcatcagcagacagcgacagtttgacctcctcgttactaatttggatgccctttatttctttctcttatctgattgttctggctaggacttctagtactgtgttgaagaggagtggtgaggtgggcatccctgcttgttccagttctcagagggaatgctttcaacttttccccattcagtattctactgactgtgggtttgtcacagatggcttctttacattgaggtatgtcccttgtatgccaattttgctgacagttttaatcataaagggatgccgggttttgtcaaatgctttttctgcatctatggagataatcatgtgatttttgtctttaattctgtttatgtggtgtatcacatttgttgacttgcatgtgttaaaccacccctgcatcctagtatgaaacacacttgatcatcgtgggttatctttttgatatgttgttggattcggttagctagtcttttgttaaggaattttacatatgtgttcctcaaggatattggtcggtagttttctttttttggttatgtcctttcctggttttggtattagggtgatactgacttcacagaatgatttagggaggactccctctttctctatcttgtggaatagagtcaataggattggcaccaattcttctttgaatgtctggtagaattctgctgtgaatctgtcttgtcctggacttctttttgttggtaaattttttttttttttgagacacagtctcgctctgtcgcgcaggctgttgtacagtggcatgatcttggctcactgcaacctccacctcccaggttcaagagattctcctgcctcagcctcccgagtagctgggactacaggcatgtgccaccacacccagctaattttttgtatttttagtagatacagggtttcaccgtgttagccaggatggtcttgatatcctgacctcatgattcacccaacttggccttccaaagtgctgagattataggcatgagccaccatgcccggcttggtaatttttttattgccatttcaatcttgctgctgcttattggtctgttcaaggtatctaattcttcttgatttaagctaggcagattgtatcttttcaggaatttatctgtctcctctaggttttctggtttatgtgcctaaaggtgcttatagtagccttgaatgatcttttgtatttcagtggtgtcagttgtaatctctcctgtttcatttcttattgagcttatttggattttctctcttcttttcttggttaatcttgctaatggtctatcaattttatttatcttttcaaagaaacagctttttgtttcattgatcttttgcatttgtttgttcatttgtttcaacttcattaagttctgctctgatcttggttatttcctttcttctgctgggtttgagtttggtttgttcttgtttctctagctgcttgaggtgtgaccttagaatgtctgtttgtgctctttcagactttttgatgtaggtgtttagggctataaactttcctcttagtattgcctttgctatagcccagaggtttgggtaggttgtgtcgttattcattcagtttgaagaattttttaatttccatctcgatttcatttttgacccaatgctcactcagaagcaggttatttaatttccatgtatttgcatagtttcgaaggttccttttggagttaatttccagttttattccactgtagtctgagagagtgcttgatataatttcaattttcttaattttattgaggctcattttgtggcctatcatatggtctaccttggagaaagttctatgtgctgatgaagagaatgcatattctgtggttgttgagtagaatgttctgtaaatatctgtcaatatccattttttccagggtatagtttaaaaccattgtttcagtgttgactttctgttttttttttttttaagagggagtcttgctctgccgccctggctggagtgcagtggtgtgatctcggctcacagcaacctccacctcccagattcaagtgattcttctgcctcagcctcccaagtagctgggatcacaggaatgcaccaccaagctaatttttgcatttttaatagagacagggtttaaccatgttggccaggctggtcttcaactcctggcctcaggtgatcctcccaccttggcctcccaaaatgctgggattacaggcatgagccactgtgcctgacctgactttctatcttgatgacctgtctagtgctgtcagtggagtattgaagtcccccactattattgtgttgctgtctttatcattccttaggtctattagtaattgttttataaatttaagagcaccagtgttaggtgcatatatatttaggattatgatattttcctgttggacaaggccttttagcattatataatgtccctctttgtcttttttaactgctgttgctttaaagtttgttttgtctgatataagaatagctactcctgcttacttttggtttccatttgcatggaatatctttttccacccatttaccttaagttgatgtgtctttatctgttaagtgagtctcttgaaaggcagcagatagttggttggtgaattcttatcaattctgcaattctgcctcttttaagtggagcatttacgctatttacattaaatgctagtagtgagatgtgcggtaccattccattcattgtgctatttgttgtctgtataccttggttgttttttttttaattgtatttttgtttgataggtcccgtgagatttatgctttaaagaggttctgttttgatgtgtttccaggatttgtttcaagatttagagttccttttagcagttctcgtagtgctggcttggtagtggtgaattctctcagcatttgtttgtctgaaaaagattttatctttccttcatttatgaagtttagtttcactggatacaaaattcttggctgataattgtttttgcttaaggaggctgaagatagggccacaatcccttctagcttgtagggtttctgctgagaaatctgctgttaatctaataggttttcctttataggttacctggtgcttctgtctcacagctcttaagattctttccttcatcttaatttagataatctgatgacaacgtgcataggtgatgatctttttgtgtttaatttcccaggtgttctttgtgcttcttgtgtttggatgtctaggtgtctagcaaggatgaggaagttttccttgattattcccccaaatatgttttccaaacttttagatttctcttcttcctcaggaaggccaattattcttaggtttggtcatttaacataatcctagacttcttggaggctttgttcatattttcttcttttttctttgcctttgcaggattgggctaatttgaaagccttgtcttcaagctctgaagttctttcttctgcttgttcgagtctattgctgagattttccagagcgttttgcatttctataagtgtgtccattgtttcctgaagtttcgattcttttttatttatgctatctatttccttgaacatttctgccctcatttcttgtgtcatttctttgacttccttaaattgggccttgcctttctctggtgcctccctgattagcttaataactaatcttctgaattctttttcaggtaaatcagggatttctccttggtttgaatcgaagtgagctagtgtgattttggggggtgttaaagaaccttgttttgtcatattaccagggttggttttctggttccttctcatttgggtaggctctgtcaagagggaaggtctagagctgaaggctgttgttcagagtcttttgtcccacggggtgttcccttgatgtagtactctcccccttttcctagggatgtggctttctgggagccaagctgtagtgattgttatctcccttctgggtctagccacccagcaagtctacccggctctgggttgtctgcagagtcctgtgatgtgaaccatctgtaagtctcccagccgtgcataccagcatctgctctggtggaggtggcaggagggtgaaatggactctgtgagggtccttatctttggttgtttaatgcacgatttttgtgctgtttgggctcctgccaggaggtggcgttttcaagagcacatcagctgtggaagtatagggaggaacaggtggtggtcagggccctggaactcccaagaggatatgccctttgtcttcagctacccgggtgggtagggagggccattaggtggggacacggctaggcatgtctgagctcagactctctgtgggtgcgtcttgctgtggctgctgtaggggatgggggtgagattcccaggttaatggagtgatgttactaggaggattatggctgcctctgctgtgtcatgcagcttatcagagaagtgggggaaagccacagtcacaggcctcatccagctcccatgcaacccaaagggccaatctcactcccaccatgcccccgcaacagcaccaaatctgtttccaggcagtgggtgacagggctgagaactcgccccaggctccccacctcccagctgtgaaagcaagtagggctttcatgcttcccctactgtggagtctgactcgcgccctcccccgggttctggccaggagacttctccatcagctcaaattgttacaaagttcagctggaggtttccttctccctgtggccttctcccagtgcctctggcagccctcctcaaggcccccgtgaggcagggcagaaatggcttgctacgggacccatcgagcgagcccatagggctcttcctgctgcttcctctacccctgtatttcacttggctctctaaattgactcagctccaggtaaggtcagaatcttcttccgtgatctagaccttcagggttcccagtgaaggtgtgtatttgggggcagacaatcctgctttcccacttccgcagtttgggcactcacagtatttgaggtatctcccggctcctgcaggagcaatccacttccctcagagggtctatgggttctgtcggctttcctgatttgttcctgcagtcgctctggagcaagtgttcacagtgcaaggctccacatgctgctctgtctgtctgagtggaagctgcaatctagtcctgcctcccgtctgccaagatcctcccactttcatcaaagtcttaaaacatgccgcgtgcctgtagtcacaactactcgggaggctgaggcaggagaatcgcttgaacccgggaggcggagcttgcagtgagccaagatcacgccactgcactccagcctgggtgacagagtgagactccgtctcaaaaaaaaaaaaaaaaaaagtcttaaaacaaacatcacatcagcaaaataccgtgcatttgtagagtaggtgagccttttggaaaatgtgttcccccatctaattacattcccagcactagctgtcacaatgccaccattaaaatggggaaagacagagaatttaaaaaacaaaaacaaaccaaaaaaaacccagatttttaaaatgtgatcagttctgacactgcaactgctataaaaccaataaaaaatacaatagaaagagagcgggtttggcatgaagggctgtcttagttgtcacagatgccctctcagatgatgagcagaggtgttgccctgtccagatctgagcatacagctttctacataaaggaaacagtgggtgcaaggccctgaggctggaacgagcttggcatatttgaggaaccacaagaagactggggtagttggagaatagcaagctatgacagagtggaaggactgtgacaggagatgaggttgaagagagacaagaactagaaagggagaactcacaagtcatagcctggagtttagagttgatgctaagggccatggggagtcactgaaagtcagggatgtgtaagtaattaattgggaattttttaagtgaatatattgtccgcaaaaagtttgtgaagcagcttatatccactattcactttttacttaaataaatttacgcctatttttttttcttttttgagatggagtctcactcttgtctccccagctggagtgcaatggtgcgatctcggctcactgcaacctccgcctcccaggttcaagtgattctcctgtctcagcctctccagtagctgggattacaggtatgcaccaccacgcctggctaatttttgtactttcagtagagacggggtttcaccacattggccaggctggtctcaagcttctgacctcaggtgatccacccgccttggcctcccaaagggctgggattacaggtgtgagccaccgcacccggcctaattcacgcctattaatgtatttttcccaaatgcaaatagctctggttttcattttcttataaaatacctgagattctttcactgcgaatccttccaagtacctatgtttttataataccctatgtttctttaccacatcaattatagttacggttataaacaaattaataattggaataattatctatttttgtcttttcttacagactgtaagctcgtgtgtgcagattgagtgcttgaacactcagcacataactgagatgccagaaaatactttcattaaataattactataatcatataagctttattcacttactataatatgaatatttctcatatcaccaaacttttgcgttctacacttttgtatagttgcaatatcctgctgttgactaatgaagttcttccaagtttcaagaatgaatttttattctacataaaaatgttcctatttgcttaaatagttaacttacagggatttcttaggtccctgggctgctgtcttatctcagtgtaaataatagtgaaatggagtcttttaaagtgtctcctaatatgttgtgagttgatttatgtccctgaaaaaaggtatgttgaagtcctaacccctggcaccttagaatgtgaccttatttggaaatagggtcatcgcagatgtagttagttaagacaagctcatactggtgtgtaggggtgggcccttaatccaatatagtaacttgaatccttatttagaaagagaaggcatgtgaagagacagacacatacacagagagactccctgcaaggactgcagttatgctgcctccagccaagccactaccagaggccaggagagaggcttggaagagatcctgccccaggatcctcagagggaacatggccctgctgactccttgatcttggacttctggcacctccataactgtgagataataaattgctgttgctctaagccacctactttgtgatactttgtgacaatggtcctaggaaactaatccatcgtcagagacagctaaactacacttgctcatctgggcagaagttgtgcagatccatcttaatcataccccagagccattgctgtgatgcccacaaagctggatctcaagtcacagggacaagagataaaggggtaatttacaaaattaaacacagcctgcccagttacagttcaattttaggaaatcatattatataatactggaacatacttatacttaaaaaaaaaaggtgttgttcaaggtcaggagttcgagaccagcctggccaacatgatgaaacccccatctctactaaaaatacaaaaattatccgggcggggtgacaggtgcctgtagtcccagctactccggaggctgaggcagggaatcgcttgaactcaggaggcagaggttgcagtgagccaagatcgcaccactgcactccagcctgggtgacagagtgagactctgtctcaagacaaaaaaaaaaaggtgttgtctatctgaaattcaaatataactgggcatcctatgtttttatttgctaaatctgacaaccctaggaaggcgaccagcaggaggtaaacatgcccttgggacgtgctagggcaggcgatgtcttcacttctgagcactcaccctggcggtccacacttaacaggagttggcccagagagacggaagcaatccatgcaaatcccctctcaggctcagtgagatgcatttggaaaaggtgaaaaagatgtgcctcagagaatcagagaagcaaaaagagtgactgctagaagactgttgtaaaatgagtgggtaaagccctgttggaaatggaagaagataagaaaataaaaacaaatcctcctattgccattacttgtgctttgtgacattgtttattaaccaagtagaaatattaccttaaaataccagagattataactaagacactggaagagggatgtaagaaagaatgtttagtttctgtttactactagaagaggctcaagaaaatgttgaagtgtaacacagaaatgaaaatgtattttaaggctgagtgcggtggctcacgcctgtaatcctaccactgtgggaggccgagtagggaaggctgagtgtggtggctcacgcctgtaatcctaccactgtgggaggccgagtagggaaggctgagtgtggtggctcacgcctgtaatcccagcactttgggaggccgagtagggcagatcacctgagtcaggagtttgagaccagcctgaccaacatggcaaaaccctgtctctactaaaaatacaaaaattatctgggcctggtggcgtgcgcctgtaatcccagctatgccagaggctgaggcatgagagtcacttgaactcgggaggcggagcttgcagtgagccgagatcgtgccattgcactccagcctgggtgacagagcgagactctgtctcaaaaaaagtaaaaataaaaataaatatttgaagagggctaaacaaattacagcaaaatttcctggcattaatataagagcagatgaagatgtccactctcatttgatgtttgtgatagagaggatgatggaagggcccaaagttagataaattcaagaagctcgcaaaagaacgtgcacttctgggtgttcagacaaatggatctggcagacacaaagcccagaggctgcaggtgaactagcttgaggataatgaatagaaaatgcaaactacccccaaaaagagtgacacaaggaaaatgacgttctgaagtaagaaaggggccaaaaacaggaaagacggaagcaggtaagtttgataatgatgctgaaaaggcctaaacaggattttgacgcaagagatagaattactttcccaaattgcagggttcagcatccagaattcagttgtcaaggttgaattcaaatttgggttaggattatcccaaacaaaaatgataaggaacactcctacattattgtgggaataaatccaagggaatttacttaggctggggaaagtatgtttaaaactcagtagctcccatttcaatggcaaagacacagtaattttcctaaaacaagaggcctgctgtgcattttctagtaagaacctacaaaactgaagctggtgaataaatcatttaaatcaaggaaaggagatacgctgcaacgcttaaagcatcctagaggagtgtgactgtcaaaaataccttctgattatgtgacgtgtttaagactggagctctcacgaaggatccatttgaccactgtgcaatctaagcgtgaggagagtgtgaaggtcagtgatctttctgctaatactgaacatgtctcagactacgccaccggagacagggagttgcatcaggaaacaccaaaggaagagcaaaaggagaagctgaaaacacaagaaaaccaaatgcatttataaaaaaaaaaagaagaagaaacatcaagctgccttcttcaggtctaggagactgtgcattgaatttgcacagaagtttctagcgtgatggatgaaacctggttgccatccaaccaggaaaaagaaaaagcaacattaaatgtcgccagggccttttccctgcagtaataacacaactggcaaggatatcctgaatatagcacataaatatgttctttctgcttcttgctagcaggagatacaaacagcctcttccacgttttcatgttcatgtttattaaagtcacagacataaaatgttaaggttctaaagaatgaaaatgtcagtgttggtataaaagtatgaacaccttgcacaggttattttaggaggaaaatttgatcatggcaccatatattttcatatatattttaggattatccaccaccataaatgacatttctcagacaactgtaaatagatcactgcacattgcagtcatttgttcactgagcatgcacagccaggtgctgtggagggaacaaacatgaaaacaaacacacacaaatgtggggcccgcctgccttcaagctccaagagccagactctctaatgagccattaagcatgatcagaaacacaaaacggaaacaaaaccacaccgtaatttaagataaaaagtgattaagtgtcattagagaagcagaggtaaactgtaaccagagttctgagaagagtgtccagggacaagctgagaggccgtcagcgttgcacgaagccttgctgcctgcttcaaggacatctggtctgccggcatctgagggaagaggctgaacaaagtatttccttagcacaaacagaaaaataaatactttgagttatgtaggatattgacattggtgttcatgtacttagtaggtctcatactgttttgctgtaataaccccagtggtgaagaaaagcaaatgtatacccctagtcaatgtggggtgacggcccaagcatcctgtctcaaacaaaacatgtttttgctgtctcttttgttgttgttgtttttgagacacagtaccccaggctggagtacagtggtgttatcatagctcactgcacctcaaattcctggattcaagcaagcatcctgcctcagtctctcaagtagctaggactacaggcatgcactaccatgtctggctaattttttcattttttagtagagatgggggtcttgctatgttgctcaggctggtcttgaactcctggcctcaagtgatccttccacctcagtctcccaaagtgctgggtttacaagtgtgagccaccatgctgagtgaatgtttcacatttaatctcaaaaattcatgtaaattgttcattctactgcatatcatatcctagttcagttaaaatggaatcgttagttatcaggaaaataaaaataaaaaccataataagataccactttataaccactagtatagctataataaaaaagacagataataacaagtgttggcaaggatgtggggaggttggactcttctcatacattgcaggtgggaatgtaaaattctgcagctgctttggaaaacagtctagcaattccccaaatggtgaaatatagacttaccatatgacccagaaattccactcctaggtatctacccaagaaaaatgaaaacccatgtccacacaaaaacttgtatacaaatgctcatagcaacattattataatagccaaaagcggaaacaacccaaatatctatcaactgactaatggataaacaaaatgtgatgtattcacatgatggaatatgatttggctatgaaaacgaatgcttcaacctggatgaaccttggaaacggtaagtgaaataagtcagtcacaaaggactgtatattttatgattccattcacgtgaaatgtccggaataggtaaatctatagacagatagtagattagtggttgcctagagccagaaagaacagggaaatacagaggtgatgaacaaagagaataggtttctttttggggtgatgaaaatgctctaaaattgaatgtggtggtgattgcacggctctgaatagactaaaaatcattgaattgtacactttatatgggtaaattgtatgatgtgtgaattctatttcaatacagttgttgcaaaaaaagaaatttatatttttaaaattttgtttttagagacagggtctccaatctgtcacccagattggagtgcagtggcgatcatgacactgcagcctggaactcctggccccaagcgatcctccctccccgctcagcctctcaaagtgtgattacaggcattagccaccttgcctggcctaaaatggaatttttaaatcctatgcttaaaaaaaaaaaaaactgcaatagcacatgctaagcttgacaaaggcgactaatagaaaaatttctgaaggaaaacaggcaagtctgccatatcccctcccccgaggttattaaaagttagcagtttggaacatacttgccagcctttttctatgcttttacctactaaatgtgcacttagacgtttatgtacgtgcatttatgcaaccttgtttctaagaaaattaaataatttgctgccagcatactcataacctccccattctttctgcgaagtggctacttcctataccactggaacaaaagtcgtgtgcgtaacccaacatgagaagcgcacgatttagttcagtgttctccgtcctccacggttcgcagttgtcacctccaaggcctctgaggatgaaggactgggacaggcagaggcagagcccctgccgggaagcagagaacattaaggtggcagcctcagccctgcctctccacttgcccaggccagcgttctcagcgcacctgccgcgccacaccccccgtgccacacccccctgtgccacacaacccccgtgccacacaacccccgtgccacacggccaacacacgccacacgcccccgcgccacacgcccccgcgccacacggcccccacgcgcctgctgctgcttcctgccctggcacctgtcctccgctctcttctctctgtgccgccctcttccattgagtgctgccgcttacccagagccgaaacgtcatctgcccctgggatttccgtggctgttctgagtcccacacattcatctccctccagtcctggaggcctctaggactgcggtagggaggggaaagccgccgcgagtgggccagcttgtcagtcaccaaaccccctgcattaggactaattcttacctcatatgacttgtttccttttgcttttagagacggagtctcgctctgtcgtccacactgcagtgcagtggtgtcatcgcagctcactgtagccttgaacttctgggctcaagcgatcctcttgcctccgcctccccactagctaggactacaggcaggcaccaccacgcctggccaagattttattttattttttgtagggatggtctcactatgctgcccaggctgtgtggtccaaactcctggccttaagtgatcctcccacctcggcctttcaaggtgctggggttccaggcatgagccactgcagcttgcctgttttgaggattactcgcatacacaaagaggcatgcagacttcagcaaggtgatttttattttcaagatcacagagctaatcaatatcggaatctggattgtgacacagatcccttcctccatgtttaatacactttccactctacttctgatatgctttaaacagtattccaaaatgattgttaaagaggacattttgaacatatgtcagtaaaataattgtattacaggaagcaaataaggaggcatgattgtggcattctcagccatttttaaaaaaatagttcatgtttcctcttagcacttccattgtgtgagcagagtctgtaataacgtgctcagtctacaacatcacttcatatttttcatttcatatgagttcattttttgcaggtataagaaactatcttcaggtttcagataaaattgcaactgaacttttaaaacctaagtttttgttgagtccaggccataaaaatctatcagaaggacctaagccatttaatcatccagattatcagcacttctacaaaaaggttttaaatggcaagaagataaaatgttaagtgaggatagtaattatttgcctttatctcttgtgccaggtttcaaacctcaccatatgggtgtttgtgcaagattaaatagctattcaagtgtgtaatgaagtatagatactaaattgaaccaaaagatatagcatggaataggtcagagaagatccactctgcagaaatggactatgaaagagttgattgatagatattcatgattccaatccgacgtgtactttgagggccttttaacaaaatagagaaaattcttctttttaaattatttcctataggaaacaaaatactacgggggaagtagcaaggaaatttggggtgaaaaaatagactgccatctgcaaatatcctccagaagtagactgaatgaataacttgatttgctcaggatggcccagtgtaagcattaataattaatgtcaatctccttttactcttagaaatgtcctagtttcataaattacggtcactctatctggaatgatttttgagagctatcgtcagagtcaaaaaaacttaagcatgaaacttgcctccacaataagtcactaaatgtgctttcaagaagacacttgagaaggaaaggggttataaaaggtttagaaaatctgagctatactctaggaatgtgatagtcaacgtgtgtgtgcatatgcataacagggagagggagattgggaggccgaggccggtggatcgtttgaggtcaggagtttgagaccagcctggccaacatggtgaaaccccgtctcaactaaaaatacaaaaaattagctgagcatgatggcacgcgcctgtaatcccagctactcgggaggctgaggcaggagaatcgcttgagcctgggaggcagaggttgtcacgagctgagatcgcaccgctcaactccagcctggatgacagagtgagactctgtctcaagaaaaaaaaaaaagagagagagagggagagagagatggagagataagcaacagtttaggtcatctgatgcaggatctgttcacccttcactcagaactcaaacaatggggaatggtaaatgtatcaagattcatgtaaaactggaataaaatcaatatattttagaagcaagatgtgaatttttcaggaaacacagaaaagcaaataggatgaatgctttcgtttgtaaaaatttccaagatatactattagatagcaaaagcatacagcaaaacataaagtgtgattctattttttgaagacatattaaatatttgacatgctttagaaaatgtctgagggactacataccaaacagttaataatagtgttgtaaatgggtaattgtttctatctgggttaaatgtgattacatgcttactgcttcccctctgtgtgtgtgtgtgtgtgtgtgtgtgtatgtgtgggtatgtatgtgtgtgtgtatgtgtgtgtgtgtgtgtgtgtaagtgtgtctctccgcctcagtcacaacagaggtttcttcttcagtgtgaaccctgacatgagaaaacacgcagagcccagcagagattcagctgcctagcagccgcgtgcagtgtgaagaagaaatcaacagagggtttcggttacagcacaaagtgactaatacaagcggtcataggtgaagggcaagattcctaaaaagcgtttttccgcatttatttctatgatgaaagactttcttatagccagtactaatgatgaagctgtgcaacaacaatgaaaaaaattcaagcttctcatttattcccttcttaccccctcctcattcacagccacaaaggaagtactaccaccaccaaaccaccaaaaggcaaagggtagacaatgattttctgaggtttctttcacctctaagttatatatatatttttttgagacggagtctcgctgtcgtccaggctggagtgcaggggcgcgatctcggctcactgcaagctccgcctcccaggttcacgccattctcctgcctcagcctcccgagtagctgggactacaggcacgcgccaccacgcccggctaatttttgtatttttagtagagacggggtttcaccgtgttagccaggatggtctcgatctcctgacctcgtgatccgcccgcctcggcctcccaaagtgctgggattacaggcgtgagccaccgcgcccggcctctaagttataatttttattgtaaaaaatagatgcatatttagatatgtgtgactttgggggttgtgttttaaatagcagctgattttgttttagtctatattagcatctcaggttcttttttaaaatctaagcaaatcaaaatgacttttcagaccaaatgtgtaagttttaatccatcctaatttcatgatgaactaaaaagcacaactgggtcatagtggaatcaggtcattcaatataaattactacataactaattcagttgcaactcaattgaaaaggtaaatagtcatgacaaccaagctaaacaattcttctaaggtagtttatggaaacataggcaaggcttcttttcatgaattttaaaacatccttcctttgtagagatggtgaaatatgtgccctccttttcccctagtttctcctcagataacctcattcaacctcatggttttaaataccttctctctgtggctgctgatgaccaaatttttaatctagccctgaaacactcttcaaacattcagacttcttgaaatcaaaacgctttcttgaaatatctcataggaaccttgaatcaatctcaaccaggaggaactgcctgactttctccagcatttcctacttcaggaaatgccattgttaaagacatgttcgctgaataacctcaagggttgagaattcaagtgaaatactaaaattcagtctgctgccattttaagtagccataaaaaattaggtcccctatataaagaaatacatcaagttcaaaaatctttaaaattaaatggaaaagatattgacatgtcttaggatcccatcaaggtttgagttttataacctgtattctggataacctcgtttcactgagatggtaaatctttttcagtaggctatctttccacatgaggaagattaagaactacgtgaaaatgtttaagagaatcaaagccaagatataatattttgtattaaaaagaatccctctctacttggtactttatgttataatgtttaagatcatttgaggaattacaatgacagccttttaactttaatttatgtacaaattaataatctgtttagattaatggcttctgttattctctgtatcacagtaacacaaatgcacatctccacatacaattttttctcaaagttttatacaatcaactgcctatttgacatctccactggaatgtctaaacagaaaccttacgtgttaggtgtccaaaacccagtcctgactttccccctaaacctgcagccttccccatttcagttgatgacaagttcattcttctctattcctgagaccaaactccctggaagtcatattagactctgcttttctcactccccacatccaatccattatggaatcctagttacctgaagtttgcacatatcccacatctgacctcattcacttccaccaaagtgacttctgcctcctttttgccctaaagactgttctaaacatagcagtcagagtgatccaggtaagacctaaatcagatgctgtctctcagcatcactcagaataaaagacaaagtccacacaaggcctgaggagctttccctccccattaccagtttaacttaatctgccgctgccctgcccctcaatctcctcggacaaagttggcacgctctctgcactggctttgcactggctcttctcactgtccaggacttcctttccccagatcaacttggcaaattccttcacctgcttcacattgtcacttaaatgcaccgtcccaataagactcaacctgtccatcctgtttaaaattacaactcattttaaattcccaattgctctgatcatgttctattgttttccttcttccatagcaggtatgtgcgtatcacctaattatcacatcatttactgatttgttacacttatcatttttatttattggaaacaaatgctttctatttgactgtattaataagttccgggaggaaaggggtatttgtggatgcttcccaagtgcttagatcagtgcctgacacatagtggccactcaatacatatctattattgctgacttgcgactttcagtaaacatcacactaagttaacaacaatatcatatattaacacatgaggaatattccaaaaaatacagattttccgcctctcagaccagattgctgcttacttggtgttttgtttgtttgttttgtgttttttgtttgtttgtttgtttgtttgagacggagtttcgcccttgttgtccaggctggagtgcagtggcctgatcttggctcactgtaatctctgactcctgggttcaagcaattctcctgcctcagcctcccgaatagctgggattacaagcgcacaccaccacacccagttaattttttgtatttttagtagagacgggatttcactatgttggccaggcccagttaattttttgtatttttagtagagacgcggtttcaccgtgttggccaggctggtctccaactcctgacctcagtaatccacccgcctcggcctcccggagtgctgggattccaggagtgagccaccacgcccggccctccttgggatttttaaggtagtgcattacggtccatctcactcacctaccagcttcttcaaaacatcttcaagaaacaaattcccattttggttgaagattgcactttgacacacgcatttaagtataacagtatattctatagtaatttgagaagtcctgttggggttaaaaagcaaattctttatgtctccaatgtactttctccactatgatcagtggcttctcaagagtaactccttgaataagtcacacatttctgccagtttaataccagtcttggcttctctctgcctcaggatgcagccaatactcctgaatgtggctaagaaagtccttcataagcacgtttctgccattcctttagaatcctcttttgacacaattccctctcagcagaaacataaactctacctgaacctaccattttctgcctttaggttttaaatatgctactctctttgcctacatcacctcattcgctaatgcctactcaaccacttgatcacattccaagcttttagttttcttccttcccaaagacttccttaatccttcaagaactggataaagggttccctgagttctcataacttctcataatgacccgcatctttgcactgttccctccagtgagctaacacagtgttgggatgagggaggcgctaaagagacacttgccgaatgaacgagtgaattttctgaagaagcagccagtgaatcggagccggcaatttctctctcaacaatgctctctgctgtgccattcaacgaggccacaatgccattgtgtgacaatggtatgatgacactgcttgggccataacagaataattctccagataacatatgcacttgttatgcagctagatgcttttatgattgcttttggaggtgatgtggcaaataaattttttacttttataggactgctgacatctcacagaaatttttgacaaatattcaactcagatatgattttggttctactttatggatttcctgatcctttatatactacattttatttctttatgagcttactctgtttcatttttagccctcaaattcaatgaccaagataatgtaacagcatgagcacagaatatgacctctgctcagaagaattccatttccatgtaatatatgtacagggcttggtgaaggatgaagctgctcttcagcctccctctagttatcaactaacacagcaatttctgatgctttattatttttttcctgaatggctttttctgtagtacccattcatgccttctgatctaattagtataattagccttggacacataagaaacaaagcaacaaataaaaaagcccataaaattccatttcaataccctgcctttcatagactttatggaactaagtattcagctgtcttcatagctcataacctttaatcctaacatcaatctcagtgttctattcaattacaactgctgtctattgagaagtagcaaaggttttgaagagtttgtgggaacgtggaagttgccccattcattttcattagtaaactcaggagacacaaatttcactaaaattgctgacactgttcctgctgtgtctggatgatttattattagacttcatatttcttccaaaatatggtttaaggaactcaagaaaatcatgcgattgttttacctgaaatatgatgtaattttatcacctgtgcactaaagttgctgactgcaacttggacagaatagcacaaaaggctttgcatggctggagggaaaggaaataaagagtgagacccataaccagcacagagtacagcacggttagttcctatgacagagacaacagaggagaaggtgtatgttgtatttgtttttctgagacaggatcttgtatgttgcccaggctggaatgcattggcatgatcacagctcactgaagcttcaacctcctgaactcaagtgatcctcccgcctcagcctcccaagtagctgggactataggcatgcaccaccatgcctggctaatatttttttaaattttatttgttgtacagatgtggtctcacgatgttgcccaggctggtctcgaactcctggcctcaagcagttctcccacttcggcctcccgaagtgctaggattacaagagtgagctgccacacccggccaaagtgcacattttaaaaaggcaacttgctgcacctagaaaaatagaaaacaattgttatttaaaaaccaagtcatgaccttttgaggcaatatcccagcgctaaacggcaaatgttatcacttgtaaaagcaattaagaaaattgttaggctgtggtgacagtgtcactgaggagcttttaagagttattttcctaagaacaatatgcaagaccttgcacacctagcccagcttacttgtcacggcttataacccgaatgccatcccactgtccacacttaaggaacacagtgctggcccagcatccccattcccgggtgcactttaggaccaccttgggagctgttaaaaattatggctgggtgcagtggctcacacctgtaatcccagcacttcgggaggccgaggcaggaggatcacctgaagtcaggagttgaagaccagcctggccaacatggtgaaacctcatctctactaataatacaaaaattagccgggcatggtggtgcatgcctgtaatcccagctactcaggaggctgaggcaggagaatctcttgaacccaggaggcggaggttgcagtgagccaagatcacgccactgcactccagcctgggtgatagagcaagactccatctcaaaaaaataaaaaataaaaataaaataattatgcctaggacccagcccagaccgactgagtcagaatctcggcggggagcattccgggtgattctaaggtctgggctctgcggggagcattccgggtgattctaacgtgtgggctgtgctgagaaccacggctttcaccacatcgagcgactgaccttgctccagtcaaagaatcttttccccccttttgctcatgtcactccctcaatctgcttttatgcagttttggctttgtctctccaggcttcacttaaatgctgctttcctaaagcaatctccatattcttccagcttttcctaaaatccactcttggatcagctagatcagctgagaatcggaaaccggcgctgaactgtactagtatcctacagaagcttcttgacctctccgcatccaggcttccacatgccaccaccagcctatttgttcttacaatacatgacccagtcacattcgtcctgttgaggactctcactaactcagaaggtattttcaagcatgtggagtacattacaattttctcttcatggcaaatttccaggagtaatttcttctgattcttaaaggagtgacatttgtctcgagcaataaggattttttgttatcttgtggatgttaggaagcatgtaactaatccgttttctctttatgagtttgctgctacaaagtttaaagccaatctgtgacccactggtggaagatgtggtcattatctgcatgatttcaaatgatttctggctttcttttctatttccaacccacatttttcattatttgctgatggcaagtttaatttgtgctatcttgttgtgcttcccctactaatttattttaccttacattgtttattgaacaatatggtgcaaaagttaaattaaaagcaaatttctcttgagttgtttccaatatttgtgtcaaaattatcccctaatctgtgcttctatagtcttttcttttttcccagatcgcaaccctaatgttattctactttgcttcgtagttagctgtatctcctctttccaattctaagtatcttggaagataatgaacatatatcttatgaattttgctaaaatccataaaaaataaatagaaattggttaataagtgtttatcattgcttgctgctaagaatacagagctaataatacttgctttgaattccaagttcattatgcaccaactggagaccttaagcaactgaatctccaagcctcttttttctaattatgaaagaggaaaaatcgaaaatactgtttacctcacaagattgttaagatgccgaaataatttttgttaagttactttttaatggcgaaatacaacccacatgactagtaaagaaaaggtctagaaagcctcatctgtgacttccttatatacacatgtatacacacatgcgcacacacactgagtctcagacactaggggaaagcttcggcccatgggtaaagaggtaggcagaaatgagattcccgcgaggtcttcctagccaggacgaaagcttccagatcacaatctaagaacagtgggataccactgaaggattttaagcagatgtgtagtgaaattgcatatttcagtcttggaaagtgactctggcttttgtgctctagaaagcatatggatacggggaacgtgacagtgaaggaagcagggatatctgctaagcagctactgcaatagcaaatgggaaagcaagatcagcttaaggcaccctgacatcatgaggtagccacactgagatccaaagctatgttctttcttttttattattattatactttaagttctagggtacatgtgcacaacgtgcagctttgttacatatgtatacatgtgccatgttggtttgctacacccattaactcatcatttacattaggtatatctcctaatgctctccctctcctctcccctctccccataacaggccccagtgtgtgatgttccccaccctgtgtccaagtgttctcattgttcaattcccacctatgagtgagaacatgcggtgtttggttttctgtccttgcaatagtttgctcagaatgatggtttccagtttcatccatgtccctacaaaggacatgacctcatcctttttcatggctgcatagtattccatggtgtatatgtgtcacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatgctatttctagttctagatccttgaggattcgccacactgtcttccacaatggttgtactagtttacagtcccaccaacagtgtaaaagtgttcctatttctccacatcctctccagcacctgtggtttcctgactttttaatgatcaccattctaactggtgtgagatggtatctcattgtggttttgatttgcatttctctgatggccagtgatggtgagcattttttcatatgtctgttggctgcataaatgtcttcttttgcgaagtgtctgttcatatcctttgcctacttgttgatggggttgattttttcttgtaaatttgtttaagttctttttagattctggatattagtcctttgtctgatgggtagattgtaaaaattttctcccattctgtaggctgcctgctcactctgatggtagtttcttttgctgtgcagaagctctttagtttaattagatcccatttgtcgattttggcttttggtgttttagacatgaagtccttgccatgcctatgtcctgagtggtattgcctaggttttcttctagggtttttatggttttaggtctaacatttaagtctttactccatcttgaaataatttttgtataagctgtaaggaagggatccagtttcagctttctacatatggctagccagttttcccagcaccatttattaaataaggaatcctttccccatttcttgtttttgtcaggtttgtcaaagatcagatggttgtagatgtgtggtgttatttctgaggcctctgttctgttccattggtctatctctctgttttggtaccagtaccaggctgttttggttactgtagccttgtagcatagtttgaagtcaggtagcgtgatgcctccagctttgttcttttggcttaggattgtcttggcaatgtgggctcttttttggttccgtatgaactttaaagtagtttttttcaattctgtgaagaaagtcattggtagcttgatggggatggcattgaatctataaattaccttgggcactatggccattttcacgatattgagtcttcctatccaagagcatggaatgttcttctatttgtttgtgtcctcttttatttcgttgagcagtggtttgtagttctccttgaagaagtccttcacatcccttgtaagttggattcctaggtattttattctctttatagcgattgtgaatgggagtttactcatgatttggctccctgtctgttattggtgtataggaatgcttgtgatttttgcacattgattttgtatcctgagactttgctgaagttgcttatcagcttaaggagattttgggctgagacgatggggttttctaaatatacaatcatgtcagctgcaaacagggacaatttgacttcctctttttctaattgaataccctttatttctttctcctgcctgattgccctggccagaacttccaacactatgttgaataggagtggtgagagagggcatccctatgttgtgccagttttcaaagggaatgcttccagtttttgcccattcagtatgatattagctgtgggtttgtcataaatagttcttattattttgagatacatcccatcaatacctaatttattgagagtttttagcatgaagggctgttgaattttgtcaaaggccttttctgcatctattgagataatcatgtggtttttgtctttgggggcagtctgtccgttctcagatctcaaactctgtgctgggagaaccactactctcttcaaagctgtcagacagggatgtttgacgttctttcattttaaagttattatataatcatggattcatttgtctctttggaagcatcttctctgtataagtaattaaaatattttcaagcaaagtactttcacagttctgcaggctgtgcaggaagcatggaagcttctgtttctggggaggcctcaggaaccttccaatcatggtggaaggcaaagggggagcaagaaatctcacatggtgggagcagaagcaagagagaggtgggagagggaggtgctacacacgtttaaacaaccagatctctggcgaattcactcactaccatgaagacagtatgaagaggatggtgctaaaccattcgtgaagaatctgcccccatgatccagtctcctctcacgtggctccacctccaacattggggattacaagtcaacataagatttgggtggggacacagatccaaagcatatcattctgctcctggccctcccaaatctcatgtccttttcacatttcaaaacacaatcatgcctttgtgataatccccagagtcttaactcattctagcattaactcaaaagtccaaagtctcctctgagacaagactagtccctcccatgcatgagtctgtaaaatcaaaaacaagttagctacttccaagatacaatggaggtacaggcattgggtaaatactcccattccagtaggaagaaattggccaaaagaaagaagccacaggccccatgcaagtctgaaacccaacagtcattaactcttacagctccaaaatcgtctcctttgattctatccctcacatccagggcacactgatgctaggggtgggctcccaaggctttgggcatttaacttctaaagctccatatctaaaattaaagatgaatggataactttttactatattagtttttattcttaatgtatttctctttttgtgttttgttttgttttgtttgagacaggatctcgctctgtcaccatggatggagtgcaatgacatgatctcagctgtctgcaccctccacctcccgggctcaagcaatcttcctgcctcagcctgtcccaagtagctgggacacagggcacaccaccatgcccagctaattttttgtattttttgtagagacagggtttcaccatcttgcccaggctgggctcaaaccgttaggatcaagcaatccacctgccttggcctcccaaagtgctgagattacaagcgtgccatctctcctggccctaatttctctttataaaatcagattttgttggaagtatcctgtttgctaaaaccttgatatctgatgcacttagcatagaaatcaggctggaaaaacgaatttgtaatagatatctaaaactaaaaaatgtaagagtcagaagcttaaatttttacctctttttggacggatgtttttctaaaataaacattttcctgccttttcaagtaaaaacattgacaataataaaaatgtcccttaatcatcctgaatcattagatattagttttattcttcatgtaattgactcagtggtgtttaggactagtggtctctaacttcaacaagtgtgggatggtccatggcgtgaaaagagggatagggtttgtctgaccctctctagtggggatgacccacggcctttgctgatgcctgaagcctacagcaaggcaatgtgtacaaacagtggcttcaccttccagaacattttctttctctctgttcttagtagttttgacttgtccacaccattcaagctaagtgtcctttataacaataaagttgaaactagcaaaaacgtccaactctgtgtggttcattaaatactatactgttgtgagcaaggatgtaatttttgtcagggatgggcttcccccatgccccctctaagattacataatacccaaaattacataagattacacctaagattacataatacccaaaagaaagggtagccctaaaatagtgatgctgaggagatactagttacatgaaaaatgatcacaaaaacaataagaactcacatgacagatttttcacttttaaaaatgtattttacataatagtttgatataaatacattctatgggagaataatatatatatttatatcaaatatttaacgtctagatttttttaagttaaaataacctccttgagcacccagttacactttctttccttccatatcttctttcgattccacttccctgaccatatgtgagcactgtttgtgctttccaaacattttcctagacatcagcacacacacacacacacacacacacacacacagttcaaatataaaatgctgctttttccaaaaatgtgatcatatcctattaaatgacctgccttttttccacttatctgtgaaaactttttatgtcaatacatatatatatgcattatatatatgcattttatacacacacacacacacacacacacacatatatatctgcctcggtctttttaattgctgtggtgtattacatatcatgtgtaccataattttttttttgagatagagtctcgctctgtcacccaagctggagtgcagtggcatgatctcagctcattgcagcctcttcctcaagttcaagtgattctcctgcctcagcctcccaagtagctgggattacaggcttctgccaccatgcccagctaatttttatttttagtagagatggggtttcgccacgccggccaggctggtctcgaactcttgacctcaagtgatctgcctgcctcggcctcccaaagtgctgggattacaggagtgagccaccgcccccagccttcagacagtatatatttttgttaaatccaattcttcactgttaaagaatactattttacattaatctttgtatatacatgtgactataatgaatatcctttgtacataatatgtgctctttctccctactcatacgtaaaattactgggtgaaaggttacattatatttaaatctgacatatacttgcaaatgccccaccaaaaaagccctgaaatttgaattcccactatcagtttttgaaagttcctattctcttacctcttcctccatgctgaatattatcagtctttttcatttgtcctcatctcatgaataaaaattacatttgtcttaatttaatctgccttattaactagttttatgtgatactaagtataattttctgtcattacatgttttctatcagatttgttatcttttattgatctttatgtgcttgatattatcatagagattaatgctgtattgtaaataattttcccatgatttttcattgtactttttcatgtgggtttttgacatagatgctttagatttttatatagacatatctgtcatttttttctttatgaattcttagcctatgtttagcatagatttttccaatgttgagattaaaaatattttctattctcatgaaatttcctttaacattgttataattttgtaatctatttttatctctataattcatctgtagtttttctggtttgaggtgggaatctacccttaattttttgtttgtgtcaattgataaccagtagtctcaatcataacctttccttattgacttgaaatataatgcgtaacagctgccaaaatgtataggtctataccaattttcttctagactttctattgtcttcctttcatttatttattaatttttgtaccaatgctgcagtattttaattatgtttgtcttgcagcatattctaatctctggtaggacctttccttttactatttaatttttttacttttacctcccacctcaacgtcctgagtagctgagactacaggcatatgccacaacacctggctagttttgtttgtttgtttcgagctcctgtaaaaataataactattatttattggaaaatctctacacctcagggactatgtgaagcatttttacatgaactattttatttaatcctcataatggccctctgagaaagtgtaatgagttgaatgatggccactcagaggatatgtccatgtcctaactgctagaacctgtggacgtgacttttgttgggaaaagagtctgatgatgcaattaaggatttcaagatcatatcatcctggattatccaggtggatcttaaatccaatgacagttgtccttataagagaaagtcagaaggagatttgatgcagaggtgattgtgtatttagaaaccccatcgtctcaacccaaaatctccttaagctgataagcaacttcagcaaagtctcaggatacaaaatcaatgtgcaaaaatcacaagcattcctatacaccaataacagacagggagccaaatcatgagtaaactcccattcacaatcgctataaagagaataaaatacctaggaatccaacttacaagggatgtgaaggacttcttcaaggagcactacaaaccactgctcaacgaaataaaagaggacacaaacaaatagaagaacattccatgctcttggataggaagactcaatatcgtgaaaatggccatagtgcccaaggtaatttatagattcaatgccatccccatcaagctaccaatgactttcttcacagaattgaaaaaaactactttaaagttcatacggaaccaaaaaagagcccacattgccaagacaatcctaagccaaaagaacaaagctggaggcatcacgctacctgacttcaaactatgctacaaggctacagtaaccaaaacagcctggtactggtaccaaaacagagagatagaccaatggaacagaacagaggcctcagaaataacaccacacatctacaaccatctgatctttgacaaacctgacaaaaacaagaaatggggaaaggattccttatttaataaatggtgctgggaaaactggctagccatatgtagaaagctgaaactggatcccttccttacagcttatacaaaaattatttcaagatggagtaaagacttaaatgttagacctaaaaccataaaaaccctagaagaaaacctaggcaataccactcaggacataggcatggcaaggacttcatgtctaaaacaccaaaagccaaaatcgacaaatgggatctaattaaactaaagagcttctgcacagcaaaagaaactaccatcagagtgagcaggcagcctacagaatgggagaaaatttttacaatctacccatcagacaaaggactaatatccagaatctaaaaagaacttaaacaaatttacaagaaaaaatcaaccccatcaacaagtaggcaaaggatatgaacagacacttcgcaaaagaagacatttatgcagccaacagacatatgaaaaaatgctcaccatcactggccatcagagaaatgcaaatcaaaaccacaatgagataccatctcacaccagttagaatggtgatcattaaaaagtcaggaaaccacaggtgctggagaggatgtggagaaataggaacacttttacactgttggtgggactgtaaactagtacaaccattgtggaagacagtgtggcgaatcctcaaggatctagaactagaaatagcatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtgacacatatacaccatggaatactatgcagccatgaaaaaggatgaggtcatgtcctttgtagggacatggatgaaactggaaaccatcattctgagcaaactattgcaaggacagaaaaccaaacaccgcatgttctcactcataggtgggaattgaacaatgagaacacttggacacagggtggggaacatcacataccagggcctgtcatgtggtggggggtggggggaaggatagcattaggagatatacctaatgtaaatgacgagttaatgggtgcagcacaccaatatggcacatgtatacatatgtaacaaagctgcacgttgtgcacatgtaccctagaacttaaagtataataattaagaaaagacttagaaaaaaagaaaacgtgctacatatatgccatggaatactatgcagccataaaaaaagatgagttcatgtcctttgcagggacatggatgaagctggaaaccatcattctcagcaaactatcacaaggacagaaaaccaaacatcacatgttcttactcataggtgggaactgaacaatgagaacacttggacacagagtggggaacatcaaacaccggggcctgtcgtcgggtggagggagaggagagggatagcattaggagaaatacctaatgtaaatgacaagttaatgggtgcagcaaatcaacatggcacacgtatacctatgtaacaaacctgcacgttgtgcatatgtaccctagaacttaaagtataataataatttttaaaaattaaattaaaaattttctattcagtaatatagacactagataaaagacacaaactatcttttaatgaatggctggtctttggaaattgtaagggaaagttccaggggcctacagaaaaaatagtgagctgaaacaagacagtgcctccaaactagaagacttcaggaagggtatatgattttgtagtctgggctcaaatagtttaaggtagaactttctatccaggaacttgttggaactggacaaaccttgtgacatgtgtttcgggactggtggagaaagcaaggcaaggtcttttagtattgatgaacacaatgttttggtgagaatcaagctgtttttcctaataagcaaaggatttttttctgacaaacaaattatttgcccacataaattgatttgaaataatttcctaaagcaagtagtgaagttatttattggtttgcagacttatctttctggggaatgaatttcccagagaaaacggtaaagttttattaacagagaaaataagaaaattgtttgctcttccatcacatttaaaataatatatatttaggcccagatgtagtgcctaacacctgtaatcccaatagtttgggaggtgaggagttcaagaccagtgtgagcaacatagtgagacccccatctctaaaacaaacaaataaaaacaagaatacatatctaaactggtgggaataaaaataatgagaatacatatctaaactggtgggatgcagccaaaagcagactttaaaggcagactcatgcactcaaacgcagcgacgaggccaggtgcagtggctcacgcctgtaatcccagcactttggaaggccaaggcagaaggattgcttgagtccagaagttcgagaccagcctgggcaagagagtgagaccctgtctccacaaaaaaaaattaaaaaataaaaataaagctagccgggtattgtggcatgtgcctgtggtcccagctactcgggaggttgaggtgggaggattgcttgagcccacaaggttgcggctgaaatgagccaagtttgcaccactgcactccagcctcggtgacagagcaagaccctgtctcaaaagaagccaacaagccaggtgtggtgcttcacgtctgtaatcccagcactttgggaggcaaaggagggtggctcacttgagctcacatgtttgagaccagcctggacaataccgtgaaaccccatctctacaaaaaatacaaaacttagccaggcatggtggcgtgtgcctgtagttccagctactcaggaggctgaggtcagaggatggcttgagcctgggaggcagaagctgcagtgagccaagatggtgcaaatgcactccagcctgagtgacagagccagaccttgtctcaaaaaaagcaaacacaggaacaaatacagagatgagaaaagaatcagagactgtaagtaaattactttaaatgtccaaatttagaagttaagtgaagaagaagaaataacctaaagagagtaaaagaaagaagataacactaaaatcagaaattaataaaatataaagccaagatataattagcagagacagtggggcaacactaattccttgagaagactaataaaataaaattgtttttaactttattaatattagtaagggggtagcgaaacaacaaaaagaaatataatgtctgggtagtcccatgaccattaggaaatgtggaatttttgagaaacttatcacaatgaaaaaattagactcaaaaggctttttgttttgttttgttttttgtttttttactgtggtaaaatacgtaagaaaagttaccatttggctgggtgcggtggccgggtacaggatcacacctataatcccagcactttgggaggctgaggcaggcggatcatctgaggtcaggagtttgagaccagcctgaccaacatggagaaaccctgtctctactaaaaatacaaaattagccgggcgtggtggcacatgcctgtaatcccagctactcgggaggctgaggcaggagaatcgcttgaacccgggaagcagaggttgtagtgagccgagattgtgccattgcactccagcctgggtgacaagagcgaaactccatctcaaaaaagaaaagttataattgaatcctttttaagtgtacatttctgtggcattagacacattcgcattgttgtgcaagtataccaccatccagaacttttccagctctcccaactgaaactctgtacccattaaacaccaactcccaacctcccgtctcccagcctctgacaacccctattctactctctctatgaatctcactactctaggaactttttatgaatggactcctgcaacatctgtgcttttgtgactggcctatttcacttagcataatgtcttcaaggtatatccattgtgttgtggcatgtctcaaaatgttctttcctttaaagggtgagtgatattccattatctgtatattctatattttgtatatccatgcacctgtcagtgggcacttgggcagctttcaccttttggctattgtgaataatgctattatgaacatgggtgtacaaatatttgtttgggtccctgctttcactttttttggatgtatactcggagtggaattgctggatcatgtggttattctgtgtttaactttttaaggaatggccatatagttttccacagtagctgtaccatcgtacattcctaccaacagtgcacagggattccaatgtctccacttcctttgaacacttgttattttctgggttttgatagtagctatcctaatgggtatagagtggtatctcactgtagttttgatgtgcacttccctaatttagtaatgttgaacatccttgcacgtgcctattgattatttgtgtatcttcactgaagaaatgtcaatgtgtgttctttacctatttttaattaggctgtttgatatttgtgttgttgagatgtgggagttctttatctattctgtatagctatcaatctcttattagttatatgactgacaacgcccagagagctttaaaggcaagttctaccaacttttaattgcaatcttacacaaattagttcaaagaataaaaaaaatggttaccctgaaactcattttataaaggatgtatccatcagggtttaaccagagaaacaaaatgagtaggagatgtacacttagaggttgattgcagggaactgacttacatgattgtgggcgctggcaaggcacatcggaagtccacagcacaggccatcagaaagaggagggtgggattttaggggtgaactgaaattgctgtccataggcagaatttatgttttctcagggaagcctcagttccgctcctgaggtctttcagctgattgaatcagtctcacccaggataatctagaatagtgagacaataaatattttacaataatcttcttaagtaatgtcgactgattgtagaattcggtcacagccacagaataccttcacagcatcacctgatttagtgtttgatggaataaccgggtaccagcgactggccaagtggatatgtgaaactgatcatcgcaaaagtcaaacaacctatgcaaaggccagaaaatgacagtttcaaaaactagcagccaattttagtcactaattcagattagaaatccccccgcaaaactacacataacaataacaaaaaaggccgggcgcagtggctcacgcctgtaatcccagcactttgggaggcagaggcgggcggattgcctgagctcaggagttcgacaccagcctgagcaacattgtgaaaccccgtctctactaaaatacacaacaattagccaggcatggcggcatgcgcctgtggtcccagctactcaggaggctgaggcaggaagaattgcttgaacctgggaggcgaaggttgcggtgagccgagatcacaccactgcactccagcctgggtgacagagcgagactccatctccaaaaaaagaaaaaaaaaaaaaaaaaaagtaacaaactagatccagcaatatgtgaaatggaaaaaaacaagtccaaaatataaatatttatcttgtatgaaattctagaactaaaaaacatttgaccccttatctctttaaattgtacttcaaaaaatatataataggggctgtctttataatagagtaatatgtttattgtatctgttttgaagatatactctgaataatcccttgttccacagttcaaatctgaggtaacactgaagacagaaaacaatggtgacattatccccactcccttaaggccagccctgcaatgatccggcattggaaatgctgctgctttacttcactaaatgatactttgttttgcaatttactgtgaattacatagcttaatctacgcaataacaatcctgaaaaaagaaatgtttctggtttatttctggaatttaaatgaaactggtgcttttatattcatatttgtgttaatgttttctagcatcaaagtacaaatccatttatcctttttaataatactcataaacatgaatatctgaactaaaaccttcacctataaaattagacaaatgggggaaaatattgtaaaagcaataatagttaaagagatattgaatttggctgggtgcggtggctgacgcctgtaatcccagcactttgagaggccgaggcgggtgaatcacaaggtcaggagttcgagaccagcctgaccaacatggtgaaaccccgtctctactaaaaatacaaaagttgattgggcatggtggcgccttcctgtaatcccagctactcaggaggttgaggcaggagaattgcttgaactgggacccgggaagcggaggttgcagtgagccaagatcgcgccactgcatcccagcctgggctacggagcaaaacttcatctcaaaaaaaaaaaaaaaagatattgaatttaaataggatttgtcttctcaataactaagtttattattgccaaagtggtattttagttgaagaattagaataagaagaattcaaactaaatagggcaataattgtctagaatactgaaagagaaaagtgcttattcaacaaatatttatggaatgatttttcttagtgttaaggacaacagattacagacaaataagatataattctctttttaaagatctcacgagtctaataataatctaaagaccagcatataaacatacaatcatattactatgtaataaatggtataaaaatatgcacagggtgttataaaaacatgatcatgtgggaagaagataaatcagtagcaactcctgaaggaaatgataccaaatctgtatcttgaggagaaatcacccgctagctcagtgggaaagtgggagacgttccacacaaaaggaacggtttgaaaatgagaggaaagtggacgctggagaaaattttccaaaaacattttatctctgtagaattgggtatgtgtggcgttttccaggcaaagtgtttaatcaaatggattttctgaagattgttaaactttctgtttatgttatgctaacaaagaatgcagtttcccaactgttccacaatatactacttactgagagggtgtctctccttatttctctcgtggaactagtacaaggttaaacctaccattttctgtagtgggcacccagtaagttgtctcactcccctgggaactgcactcccttcccctcccattctaatgcggctcacaggtgctactgtgttctttgaaaacccaaaaccctggccagaattcaaagacagcagtatgggcaactgactgtagccgggctaatcacaatacttcagtccttgtcgactggatttgcgatgggaacttaggctaaactgtatcaagaaagcccttttccagatttgtttgtttggaacccaaaaaaatcaagcaaatgcctttctcgtgtctgaagctctacagttttcctgtgagcataaacacagctacatagagagaatgaacttacagagacagaaacagaagaaaagaatgccaggatcagcttcatcccacaagacggaagtctattccagcaggaaacatctggagtcttcccttaaacctcccttttttaaatgttgtgagttttctttctttagctttattcattcaactagcaagcaaaacctctgaacatccagtttcaaaggtttctgccaaatgccctggctgtttagcttttctttcccttccctcattctgtctagctacaatcctcttgacaaacagagaagaaaggactggggtcacacgggagtagatgttcatttattacaagggtaataatgaaatgaatgatgagaataattataacttacatgcccatactcagaaatgatatgagctaaaaaaaaaaagtgaaattgtcagaatatgttctgtatgaacagttacccttccggttcttggggaactagcagtcacccggtgactagcctttggttgctcagagaacaatattgtaattctgtaatgaattctgtaattataatattgttctctgagcaagcaaaggggagactaaatgtgtatggtctccttggaagcatctcaacttctaatcatttaaaaattttacttcctcactgagaatgtaacctgtttgtttcccagtctttcgaagtgttaactgtctatctgctatgagccagttaatataatacatgtcaaatttaatgtgctaaccttgtactcaatataggagagacaattaaggttctccagcagcagtaagacattctctgagacagcaacagcccagtcaatgtcagctttcaagctggtgctggcctgatgctggctaaccacctgagagaaagctcgccaaggagaggtccacagtgggaggcaggtcatatcagatagcctataagcttttctcctactttcagataaagactcaaatatttattgattggcatatattttataaatatatatatagctagagagagagagagaatgttactacacaagggaacaatttatcaaaaagctgtcctgaaatcttcaaattatgcaaaggagctggattaactttgctggagcctaggatcaatcccacccaggtgacgtgtcctacactcagtgagaaatttttatgataatcttgtttcgatcattataattactggaaccttaataacaatattcaagtagtattcatctcttattacaatgcatgactggggtgctttaattggggcaaaaagacttgagaattctgaacactgtctctgtattgacggttatgtacagcttcttgcatgccatcttccacaataaatagactggatttaaagttatttataatctcaacttatagttccttcattctaagaagctagtaacaatacttagctactctagttataacaaaataaccttcatgctggtcaattctatatgctcttttttccatctttgcttcctttctatattattcaggactccttagacagcgcaggatagaaatatacattaaaccagttcaagcaatagaatggaagttggttggtttgcaggactaaaaggaatactgatgaagctcacaaaactggaagaagccctgccaaaaatcgaggcttggaaggcagagttcagtatggccaggagctgttatctggtgcatccacctcacatctctgcttggctttatgtagattgactttttccaatgacaggaaaagcgagtgctggtgacaacaaatttacagtctcccagctaagcaacacagaagaaagatgcccggaaaagccctggctggccctggttggcctgaacgcccaccccgtaggccgataattgaggtcggtgggatgcagtcatattcctcactaggctattttgttgggggcaaaatgctctggggataagactggggaaagatgcatatcgtacagggaaactagaagcaatacatgaggccaggtgcagtggtgcgtgcctgtaatcccagcacttcaggaggccaaggtgggaggctcgcctgagcccaagagttcaaggctagcctagctggctgtggtggcatgcacctgtggtcccagctactcaagtagctgaggtgggaggatcgcttgagctctccaggttgaggctgcagtgagctgagatggcacctctgcactccagcctggatggtagagtgagaccctctctcaaaaaaaggaagaaaaagaaaagaagcaatgcatgagggcagtttaagagctatcatcttggccctataatactgctcaaaatacaatctttgtgcacagaggtttgatccattggcttctgtggctttattgcctccaacatatctttaccatcgtgtctgccattggatatagattgctgcaattttctgtcccatcaaaacaaatgctggtttcgctgcaccctttccacagaaatgaatatcactggaaacttgaaatggtgtatgagagattctacaaccctttgccactttcggctgctcattagaaatgaaaaggggcctcttttatgcagtactctggcacatcaggtataataccgtgaatgttcttccagcacgagtagcttaggacattaatgcttaaacacatcatgctcagtatcttgtgggtaatattcaagtttaatgtaacatctcatttgtggctgtctaattgcatgacattttccatttctttcctcagttaatactgtgatacagagtgtcttctttttatgggacaatctctcctctaaactcatgaacaatgtgcttattgtttgtgttaagataatgcttttccctcccagctgtaacattccgattgttttattctacctcggaaggcctaagatgacctcttcgcgtgcagatctcagtccttcgctgtctgcggacctgcctaccctttgctgccttatgagagacttgaccttcaacgcctcgttagcattatgggtctctagtccaccaccagcatctaatccccaatagcttatctttgccattctatgacctagtagctgaactttctcactgtggctgccctaacagagctaaactcttgacaaacccataaagcaattgatttttttgtttggttttgtttcttagtggttctctgcttgaaataaagacatttaagggtattcatctttctctgtccaaaagcctagccactccgataatctcattttaaggccaggcacagtggctcatgcctgtaatcccagcactttgggagactgaggtgggagaatcacttgaggccaggattttgagaccagccagggtaacgtagcaagagtctgtctccagaaaaattaaaaattagctgggcactgtggtgcacacctgaagtcccagctaccctggaggctgaggagggaggatcccttgaaccaggaagttgaagctacagtgagctatgatggcaccactacactctaagcagagtgagaccttgtctcttaaaaaaagaaaaaatgaaaaagaaaaaaaaagaattttattttaaacacccttgttacaacatatcaacatatttttgtattttgtggtttttaacctccttttgttgccgcctactaatagatttaaaaagttctggtactgtgatcaaaattccttagagaagaagaaataaaccaacgctgtttacttgtaaatccactttgcaaagggagaatgagaggatacactttaaggacttagaagaaaaaggcaataattatgtttgttttacatcagcatttaaatcaaaatgaaaatgttgctttcataaaaaatgaaagcaataatgttttaattaacgggaataccaattcttctaaaaataaatatttttctgtaattactgttaatttttttttctttaataactttcttagctcagaaaggagcacagttatatgctggatggtttataagcacagctttaaaatgtcatgattttttgcagcactgtaacctacaaaaaaaaaaataataaattgtattgacaaggttttcatgcttaaacctacattttattgtaccattatccctgaacaaattgaggcacaatatttcattagactggacagatacattattgaacatacaagagaatattaaaggccattcaatagttttagcaaagaggatcagtattaggttttgtaagtttgtgtaaaagaataccttctatatcatggctatatcttttatattaggttagttttttgttttgagacagtcttgctctgtcacccaggctggagttcagtggcgccatctcggttcactgcagcctctcccacctggattcaggcgattctcccgcctcagcctcccgagtagctgggattacaggttcccaccgtcacatccagctaatttttgtatttttagtggagatgaggtttcaccatgttggccaggctcgtctcgaactcctgacctcaggtgatttgcccaccttggcctcccgaagtgctgagattacaggcgtgagccactgcacccagccttaggttcatttttaaaacacctaaaatgaatttattttaaaggaatgtattttaaaggtatttttttataaggactttaatatttagagtcattatatttagaaaagaagaggttcatactcatatttacaaaatacatctcagaaatggattctgagacagttctaacaactgttctatgaagttatatattacttattataatagatggcatacaatttagtgacagtaaaatatctgggattgaaattccacccaaacactcccccattttctgccattagagatgttcatttgtcacagagaatctaaaggtttataggacttttataagaggaaaaactgaatatttcatgtaaatattaatcataactaactggagtggctatattagtatcagacaaagtagacttcagaataggtaatattaccagggataaaaagggacattacatgatgataaaaagggtcaattcatcaagacaaggtagcaaccctaaatatatgtcaactaattatagagcttccaaataaataaagcaaaaattgataaaaatgaaagaagtcagcaaatgcagttgttactggagacttcagcactcatctcagtaattgatagagcagacagaaaatcagtaaggatatagatttgaatggcagtaacttgaccaacctgacctaaggtgtctgggtagaaggttccactcaatgtcaaaatacacatacttttcaaacgcacatggaacatgcaccaagatagatgagcagtgcctctccaactgtggtcgggtatttaaacctaaatgttcaatactgatatgaaaagtatttgttcactggacaacagcaaccgatgatggatatccttggattccagttgtttctaccaatcttgacctttactcctttgcttccaagtggtcttacaagtaaagcaaatctcagacatgcttggttgctccgacagatatctaatagcaagtaagcagtaagacagccatatagcctcttaaccactctcagtcctcagatgccctgacaagcacatcaaacaaaaggttcactccaaggcagatgcaatgatattttgttgataggatcagaaaacttcctgaggttcaatagtcatccattgagggtgggatcacaggattgaagggagcccgaccccaagggactacttggatgtgggtcttaaacaggttcttataactcctttcttcaagggtagtagagcctgtaaaacctctctttcccatcacatgtctagaagtttgctaatttcaccaatgaaatcatttttcctctattccttgtgctaattcacaatgcctgtggtttagatttagacatcaatatttgaagtcttgctgagtctacctctcaagtgtagattgccaattgaggcagttcaaatgctaatcagccatctataaggtgtagattaaagttaattcacactgacacatatgccacactctatactaattatcaatacattccatcagatgaatcagcagtatataaatcagtatgctaaaatatattaaaataatttaaatcaatttaccaaaaaaaaaaaaaaaatctcagagcagtcaaacaaatttatgttagcaaaaggaaatcagaaatcatgagattttcaacaaaccaacattggggtaaaaaattttcttttcacattttttttttttaccatttcttaataattattctctaactaccactctagtttttctaataacaaagagcaaattggctgtctgtacgcaatagaacttacctttttttcttttattctttttttttttttttttgagacagattctctctctgtcgcccagactggagtgcagtggtacaatctcgcctcactgcaacctccacctcctgggttcaagcgatcctcctgcctcagactcccaagcagctgggattacaggctcacaccaccacacctggctaatttttgtatttttagtagagacagggttttgtcatgttggccaggctggtctcgaactcttgacctcagatgatctaccagcctcggcctcccaaagtgctaggattacaggcgtgagccactgcgcccatcctagagctcacctttttttaaaacatgtattacaatgctgtgtttgataaaggcaataaaaatgtttaaatcaacatttgtttgacagtagaatttcaattatcttaattttaggagtataggaaaaacattctcattgcaccatgtacaaaaaacatcctattaacataggacatattgttagatgcaatagggttttatcaatttttttttatttaaatcatggacggttacatcattaaattgtattcactggattgaggcgttgaagaacttgtaacctcccacatcccaattttaacacctgctctttgctcttcattttgtgtatgccaaggttagttcatcattcaacttccacagcgacttatctatttataatgcttggcaaattttccaaggatttcctctagtggtacagtaaaatatgctatcacaggcctaatttttctttgaaggcttctattttatcttaaaaccccgtgtgacttttgtatgtaaatacacaatgtcttcttcgccagaaccaccgggttggttgccgtctgagctgtgcctcctcgtcaccgccaccgctatgcctggaggtcggcttcttggggacgtggctcccaactttgaggccaataccaccgccggccgcgtccgtttccaggactttctgggaaactcactgggcattctcttctcccaccctcgggactttaccccagtgtgcaccacagagcttggcagagctgcaaaactggcaccggaatttgccaagaggaatgttaagttgattgccctttcttttttctttctttttctttttctttttttgagacggagtcttgctctgtcgcccaggctggagtgcagtggtgcactcttggctcactgcaatctcggctcactgcaatctctgcatcctgggtttaagcaattctcctgcctcagactcctgagtagctaggactacaggtgtgcgacaccacgcccagctaatttttgtatctttagtagagatggggtttcaccatgttggtcaggctggttttgaactcctgacctcgtgatctgcccacctcagcctcccaaagtgctgggattacaggtgtgagccaccacacctagcggattaccctttcgatagaccgtgttgaggaccgtcttgcctggagcaaggatatcaatgcttacaatggtgaagaatccacagaaaagttaccttttcgcatcatccatgataagaatcgggaccttttcatcctgttgggcatgctggatccagcggagaaggatgaaaaggacatgcctgtgacagctcgtgtggtgtttgttattggtcctgataagaagccgaagctgtctatcatctacctggctaccactggcaggaactttgatgagattctcagggtagtcacctctctccagctgacagcagaaaagagggttgccaccccagttgattggaaggtggggatagtgtcatggtccttccagtgattcctgaagaggaggccaaaaaacttttcctgaaaggagtcttcaccaaggagctcccatctggcaagaaatacctccgccccacaccccagccttaagtctcttggagaagttggtgctgtgagccagaggacatccgctgccaatcatgttttcctgctgcaattccatgaaaacatcctggtgtcatcacaccaaggtttttaggttgctatactactggcttattaaatgaaaactggcactaaaagtttcttgggattctttacactctgtcttcaccagcattcaattctgttcatacatcagcactctctactggttctctttgaaatatgttctgtatttaaaactcaaatcttgttggatctctgcagggcttgtgaccaatgaggtcatatttgttgatggttgagaaagcttgcttccctccatcagagaatgactatccctccatcagagaatgactatcaatttttttaactgtcctattacatcctgtcttcagtcacccattttgaagagtggcagaacttgaggttcaactcctctgtaaatatccaagtataaaacccaggaacttagagtaacccagatgttctttaatactgtttggatcatagccgggggaaaaaaaactttttaattctgtacctttctagtagataactgaagaacaagggaagagacctttaaatattttgctataaaaaaatttttttgtggccaggcgcagtggctcacacctgtaatcccagcactttgggaggcagaggggggtggatcacgaggtcaggagatccagaccatcctggttaaaacggtgaaaccccgtctctactaaaaatacaaaaaattagccgggcgtggtggtgggcgcctgtagtcccagctactcaggaggctgaggcaggcgaatggtgtgaacccgggaggcggagcttgcagtgagccgagatcgcgccactgcactccaacctgagcaacagagtgagacttcatctcaaaaaaaaaaaaaaaaaaaattgtgataagtttctgtcaaaatggggagactgcagaaaaggcttcccttggcttccaaggaggtgtagcaggggtgagcaatcctagtgccatgtgcctttcacacagggtttgcctttatcagtctgctttctgatgacgtgtacatgaaagagtacaccatgagacaggaagagagaatgactgaaaatgttttattgtagaactcttcttgcagtaggttttgctatgttctggattttactttttagggaacaacaaataaaatcctttgttaaaactgaaaaaaaatacacaatgtatcaatgtctattttgacgtaaatgttaatatttaaaattgcggttgcctaaatcactttcagtttctgtatgtgttacccaaactaatttggaatcaggaacttagaggatacttctaaaaaagacatgagaggtcattgtgaaggatgagaaatgttccatgaactcactggtttttactggtagccctaaggggccgtatcattctgtttctcaatgcctgtctcagtaagaagcagaggaattttgtaaataaatatttgctccatcaatagaagcaggattaattctatatggaacaacccagtgcatgcaaggatctgtggagtttcctttattcctaaaaagccagtctgcgggcactgtctcccaggtttagacctggaagttttagaaagctatgaagtctcccactgtagaaaatagaactgtttaatgcaatctgttgctcttttgtgataaattgccttcttggaagcaaagcaagagacacctggatgagggactacaaaagctgcagaagacaatgtaacgttagttgcccttgggaagaaaactagatgacttgaggtcaagggtaaaagacttccttttaccattgaccttgtttcattttactgtttgtaccatttacatgtattatcccttttagaaaacagattcataataattttaaaataagttattttgtgacttcagaaaagagcagcaaataacatttttgtctcatttatcataatttaagccttgagggtctcacccaggcagctctgatggagctcaaagtccagctaaacaaagcttctatgcctgacactgcttcacaattgagcgtccacacagtcagtccttgcagcagaaatgagagaatgtatacaaatggaaaggttggggtcaagggacccacagccttgaacaagctccctttcgtgagacagagaggggacagaatatataagtatttactcatatatgcagaaacagtccttggaaattatggatgcctaagacctacagtaactgacattatattcacagcactgggttgcatttaataagtggaaaccaagcataatttgcttttcaacttacttatattcattgaaggattatccaaattagcaaaaggagcatccagtactaaattaaatctattaatgcctaccacaacacacacgtatttgtttgagatagaggttaggccgtgatactctaacttctaggtagaggctttgcagtattcttttcttcccttgtagaaatggaggatgagttattataggacattcatcagaatcagttctagagccttcaaacagaaactcaaaaactataagtgaccttttaatagtagaagaaaagtaggacaatattctctctctcctcacactcctctaagtgagcaagaactttcaaactgtggccacttgtatcccctgaagtaggcctcttcatgtgatcagttgttttgtggggtggagggttgtattcatacacttgctcagattagctctatgcaacaaagctagtgaaactcattgcgttgatcttagacatccatccacctgccggctctgttgactaacccatgtggctgtaggttggtgttacggatttgtaaattaggcaatcctaagacatgggtgctaataagacgtagttgaacttgggctgccttcccgtgctggtattgagaaagcgctgtagccaagactcaggttcgcgacgtttacgcccacgaagactcgggttcgccatgtttaccctcacgcatctacaacagtcctggatttttatggatcactgttcgcaatgtttacactcacgcatccacaacagtcctccatttttacggatcgcctggattttattaaaatgcagattctgattcagcaggtcgagggcagggtctgcatttccaacaagatgatgctgacacagctgggccatgacccacacttttagcagggctgagcccctcagatggtgtctggctgcagagactttcatacattttgaaatttcaggcatgagattttgaaaatttgaatacatgtaactatactacctatccaaaaaatagcaaaagttatacaagtgaaataatttttgttgaaaccccagtattctctaagagtcaggcagctgagtgaaaacatgggtaagatgagcagtaacaggccctctgtaggaatcttgcctttgagttggaagctttttatcatgctcatcaagaaagtttcctctcctagcacctctgcccagccgccccgtctgggaggtgtacccaacagagacagcgaccatcgagagcgggccatgatgacaatggcggttttgtcaaatagaaaagggggaaatgtggggaaaagaaagagagatcagattgttgctgtgtcagtgtagaaagaagtagacataggagactccattttgttctgtactaagaaaaattcttctgccttgggatgctgttaatctataaccttacccccaaccctgtgctctctgaaacatgcgctgcgtccactcagggttaaatggattaagggcggtgccagatgtgctttgttaaacagatgcttgaaggcagcatgctcgttaagagtcatcaccactccctactctcaagtacccagggacacaaacactgcggaaggccgcagggtcctctgcctaggaataccagagacctttgttcacgtgtttatctgctgacctttcctccactattatcctatgaccctgccacatccccctctccgagaaacacccaagaatgatcaataaatactaaaaaaaaaaaagttagtgtaaaataaagtagtagctttccaatatacaaacaatcaaatgatagatataatgatgtaacaaaagatgtacataacagtgattaaaatattcttaggaatatatttaacaataaaaaaaaaaaagaaagtttcctctcctgaacctcggctacaccgctcttcacagaccaaattgaagcttcactgagaatggcttcagaggatttcctgaacacaataatcatttttttctattttagatgttttgcttccagaaggcaaaaaaaaggactaaatgaacctccgagcagagcctatatgatgattttgcaggaatattaagatgggcccccccccactattattcttagcaaactaaagcaggaacagaaaaccaaatagcacatattctcacttataagtgagacctaattgataagaacatgtggacacaaagaggggaacacacacacactggggactctgagggtggagagtgggaggagggagaggataaggaaaaataacagaatctccgcttagttcctgggtgatgaaataatctgtacaacaaaccccgtgacataagtttacctatgtaacaaatctgcacatctaccctaaatctaaaataaaagtttaaaaaattagaaaaagaaaaatagccaggcatggtggcgtgcacctgtagtccagctactcaggaggctgaggtgggaggatctcttgagcccaggaggtcaaggttgcagtgagccatgattgtgccactgcactccagcctgggtgacagagtgagaaattacctctaaaaaaaaaaaaaacgagaaggtgggcctccccgtggcatgtattagaaaaagtgcgccctctggatggatgaggcccctggatagatggtgctgaaacaggtcagggacactggtctcattgtccaaggtgttatccaagctcgttgtctcacaaccaaaagaattaaggagcgtggacacagagtgaggttggagcaaaagtttaatgagcaaaaaaaccaagctctccactgtgcaaaggggagcctgagtgggctgccgtttttacagttgagtccaaaagcttttagaagaaactcctctcatctatgtagctgtttgagtaacttctcttatgtgaaaagctgtctgtaaaccccaccccttatccacgtagttgcggatatgactctaggcaagcacaatgcaccgcttctcttgtccgtgtaactgtgggtttgttttagggaagccccctcctctctgtgcaagttcccacggagcccaccgtgtacttgtctgaaaagaaggggaaacttttccctgggagctggttaatcacacgaagaacaaaaggcttctgtgccggaccttgcgtgcttgcctgtgcaggtgcagcctcagttttccccaggctgctctatttttgcctgtagctgcgatttttcaggcaggctgcttctccaaggaccagccttaactgtttacctaactgatttttcctttgcttctccctcagtgctttacacgaagaaaaagatgcccttcctcacaagtgtacctggcccacagctcaaagagcagagcttgggttggatttgtgaagggcaccatttgaccaccaccggggcagcccatctaaaactctcccagtcagctcatactaataaggaaatcttgtagaaaatggacagtaaattagaggcaagtgttcacaggaagcagtcttcttatttgcttttctaatccctctggtggcaagagagcctgagtgccgggagttcagggaggcggagaggctgacagtggcgcaacatggggctccattttccctgactctgccttggaagtctgccgcttggtgtctggtctttatacctgatacagtgtttgccttgtgttatggctgagttatatcccctcacccaaatttacatgcagaagtcttaatctgctgggcatactggctcacgcctgtaatcccagcactttgggatgccaaggtgggaggacggctcaaggccaggagtttgagaccagcctgagaagcatagtgagacctcgtctctacaaaaaaaagaaaattaaatttctaattcccagtgactcagaatgtgtctgcatctggcaataagatctttaaagaagtaattaagttaaagttaggttattagggtggtccctcatccaatctgactggcatccttatacgaagaggaaacagggacacagatacacacagacagaggactgagtggagacacaaggagaattcggccatctacaggccaaagagagaggctggagaaggagccaaccctactgacaccctgtcctcagtcttccagctccagcattgtgaggagatgccattgtgtgatgtaagcctcccagtatgtggtaatttgttatggcagcaggggggactgaaacaccttgccgctagaccttgataatttataagaaaagtcagaggtaaatgcttgtgagattatcgggaaaggatgcaccatgattagacccacaaaaggtcctctccactcccccacttcccctccccagtgcaagtccacccaggttgacagcgtgggcttgagtggaaagtcggcagcagcaacggaggcttgaagctggccttcctaacttgagactctccatgttttgattcaaagccaggaggattcaatgaccgcagtcattgcagggtctgaatagccaagaaatgcttggcttcatacaaagcactatatacggacctgtgtcaggcgaactgttgaaacagaagagacactgggagaaggcttttcccatttctccaaccactgcttcagaaaatctctgatatgcagagagtgattatttctccttggtctttctgggatgtttgaaggagaagtgaccactcctcatgcatttttcattctatagccatttaagtctattgctgccaggaaaatgagggaccgactaaatgacttctaattaaaaatataggaaagcttcaagtgacttcatgaagaggtcatggcaatatagtgcattagtaaatcaccgcaactccccagatctaggcaaataagcatagatctatttattcttgaatttttttttcaggatatgagtcctctgcccaaatccaaaggcctacttgaacacagtttcagttcctttcttctttcccagataacatcagtgaaacaatttatgttcttcctcaacaagaagaaagccaaactcttctgatactatttcaacaacccttattgctccactcacagcctccctcaggtgaagttttttctccctttctccaaacctttgccttccttctgcctcctttgtggctaaaattaacgtactgcctagaaccagacctgtcaccttctgactcacattctcccataaaggtactgaaaagccttaagaagattcatgaagcatcattagacaattaaaactgtcaatatgaaaaaaaaatgtggccagacacggtggctcatgcctgcaatcctagctctttgggaagccaaggcaggtggatcaccagagatcaggagttcgagaccagcctggccaacgtggcaaaaccccatctccactaaaaatacaaaaattagccgggcagggtggctcactataatccactgagagaatagctttgctgtcctcctttctctatggaatgccaaacacctgtgctatcttagactagtcacaggacttgaaactagcccaattgtcttatagaactgatgcttacggtttcttttgaatccacatagaaattgaccttcccagtcttaaaatttgagacagtcccatttgtcttttctgagttcctttctcaggaaaccaaccatcaggcttcctagatagtatcaaggagctgaaactcaccagatcactgcctcttgacaatgagatgccagacccctcacccatcatgactacctaaacggccaccggcttcctgttgaccaactctctctacttatcctttcctaactcctgttctcccacacagggttacatttcttccttgctatataacctccagctttggttggtcagggagacggatctgaggctgatctcccatctcctctgctgcagcacctgattaaagcttctttcttggagatactcatcgtctcagtcattggctttctgtacagcgaacagcaggacctacactgaagccctggcgttttggtaacagattcaatgatgtctcttcaaccaagttgcttattttcaccatgcagtaaaaataagtaccataggctgggcgcggtggctcacgcctgtaatcccagcactttgggaggccgaggtgggcggatcacaaggtcaggagattgagaccatcctggctaacacggtgaaaccccatctctactaaaaataaaaaaattagccaggcgtggtggcgggtgcctgtagtcccagctacttgggaggctgaggcaggagaatggagtgaacccgggaggcggagcttgcagtgagccgagatcacgccactgcactccagcctgggcgacagggggagactctgtctcaaaaaataaataaacaaataaataaaaataagtaccatataagccttgtttagataacttgtttcctttaacccactctttatgggttaaaggacaccccccactctcagcttcaatctttgccccataccactctcattatccactcttactaacagccatttgtttcactttattggattcagcttctctatccatagacatggtttctactgcatggctcctgaaacttaaatgtgcatatgaattacttgggtattttattaaaattttaatttacttcagtaattctggagtgaaggctgaaattctgcattcctgtcaagctcccaggtaatgtcagtgttgctgatctgaaattgtacattggtttaaaatagtctattgtaaccctttgtagggttttcaggttccaaacacaggctctgggagttaaattatactagtaacttatatatcacttctgccaaataaatagccaaatcaatccatcaatgaatatttgttgaatacctactccaaagtcccctgtaaaatattttcttcttagtttggtagatagtttcgaaagcatttaccatttcaagtgtttgtttgtttgtttttgcaacagagtctcactctattgcccagactggagtgcagtggaatgatctcggcttactgcaacctctgcctcctgggttcaagagattctcttgcagcctcagcctcccgagtatctgggataacaggcgtgtgccaccacgcctggctaatttttgtgtttttagtagagatggggtttcaccatgttggccatggctggtctcgaactcctgaccttaggtgatctgcctgccttagcctcccaaagtgctgggattacaggtttgagccactgcacccagccaccatttcaagttctaaaagacttatctctaaacctttcataggcagtcagtattcttcccctttctccttatctcctcatcaccaaggtttttttgttttttgtttttgttcttttgcaacagagtcccaatctgtcacccaagttggagtgcagtggtgcagtcttggctcactgcagcctccacctctcaggctcaagcaatgctcccacctcagcttcccaagtagctgggactactgacacgcaccaccacacccagccaatttttgtatttctagtagaaatggggtttcaccatgttggccaggctagtctcaaactcctggcctcaagtgttctgcccacctcagcctcccaaagtgctgggattacaggtgtgagccaccacccctggcctaccaagttttaatataagatttataattcaattgtctgaagatgggcttcagagccaaagaacatttccagtgttctcaagctacattcattcattcattcaataaatatttactaagcacacactacatacttggcactgtttcatgtactgtttactgataagcatagaacacaagacaagcaaggtccctgaagctacaaagctcagaccccaaaagggtaggaaatgaacaataaaaacataaaaaataaataatttcagagagtcaaaagtaaatgacaaaaataaaacagcataattcaatgggactaagaagcactactttggatagggtaactggggaaagcctccctggagtgatctcatcagagctgagatgtaaatgacaagaaggtgccagcctcagaaaggtctgaaagaagaggttctaatgatctaatagtcatgatttgctctgtagactgctttcctgagagttgcagttgtgtgttccgtgttccctgggtctcactgagcgtgtctgaaaaggccactttgcaaatacagtggtgcacaattacctcctgtttttgtcatcatttttagctctttccaaaaaaagattgatggagactgcctgcatgaggattggcttatcggggatacagggcagacagtcagtatagatttccatgatccgggagaaaattatctgtagaacattacaactaatcatttattcctggaaaggagggaatattttctttgataagcacttactgagcacttataacatgagaataaatgtttatatgtgtataaacagatgaaatatgggtctgtagagatgaatatgacatggattttgttgtcaaggagcttacaaataaacacaaagtaaaatggaaaaagtgagaaactggaagtacagggtaacgaaaataatcactttgaaggaagggtgactgatcttggccaagagaatctgtaaatgttcccatgagcagtctgtatttgaactaaggcttgaaataggaaacagaggagccatatccatagacagtacgaaaggccatagaaccgggtaagacacttagggaggaagtggaggaaagaagaggctcaagggctctgcccctgcacaacctggttaatagccttgaaggtgataatgcacaagaaatgcagatttcaaccatgtcagaggacgcacaggtccagcaagatgaacaacaaaacctgacctttggtttgaacattgtggaggtggtgtggtggctgggagcacagatgtttccgcgaaggggagaaagaaaaggtttatcaaagtggattcaagagaaatatgcaaggagaactgaaaattggcaccacagcccagggcttctcaaactttaaagtcactgtgaatcctggagatcctgctggagtgcagtttctgatttataggtcctgggtggaaactgagagtctgaatttctaccacaatggcgggtgacattgatgtcactgatggatcacaatttgaatagcaaaggaagagagtatttcaggagttttatattaaaaggagcaatgaaaaggactgggtgagcaaagtaactagaggaggatgtgggaccaaggatattatttttaagattcatgctatcgcagcattgtatgccaatggggatgattcagcgttcagagggggaaagtcaaaatggggagcgggataactgaacatcgtccttgagtagcgtggagaaaggggcacgcagcgatcagtgaaggggcagctctggagggaagcccagccagttcgtgcatgttaccaggggcagcagaaagctcctgcgcatagaggcaggtgagctggacgctgcacaggggttctcttctgttgttatttctcaatgcagtaaggcacttagctgctaggactgggaagaggaagaggcagcagtatgaaagaatcatgaggaagtaaattgactagggcagtggtcctcaaccccatgagacccatgaccctttttgttttgtttttgtttttgttttttgggacggagtttcgctcttattgcccaggctggagtgcaatgacgcgatctcggctcactgcaacctccgcctcccgggttcaagcgattctcctgccccagcctcccgagtagctgggattataggcatgagccaccacacccatctaattttgtatttttagtagagacgaggtttctccatgttggtcaggctggtctcaaactcccgacctcaggtgatctgcccacctcggcctcccaaagtgctgggactacaggtgtgagccaccgcgcccggcccatgaccctttttataacacatgcttttaacaaccttgctaccattgtgaaaataaaataatagtttatgtaacctacctacacacacatttttgaatcaacataattccttcaccgtaatgtaaagaaagaaaagaaaaatcgttcaggcgtgagtgtactgttgtgttaggaaggcgaaagcatctccacaagcactgtgagtgcttctagaaggcagcgagaatatctgaggcttggtgagacgctttcatcgccatgactaagggtccacccgcagttaccggttatgatttcatgggagactctcagttgtacattttgttcagctgcttggatgcaagctcagaggtggcagagttgcatttaatcaggctggcagctttactggggagtaaatggactgaaaatggtgcaaggaagcttaaggtccaggtctacaatctctatgtgcaattccaaaatccaaaagagctttgaaaatacaagttggttgttggtggttatccaaaactcatttggcagtgaaactcagcctgaatagacacaaagctatttagagcctttactgatcccacttatttgagatactacataacagtagaactgattatctttctacaatttttttaaaatctgaatttggaaacatctgtgcccttagagcttgggataaagcattataaactgtacatgtaagggaattaataaaatgacgggccaggtaagccaaggcaggtcagataggaaataaagacttgagcagttaagacacagtgaaaaaaattgggccaccggattccgggtccctgtatggcagattgtggggtggaagtgctagaagtgagacaggaagcctgggagatacagagctggatgctttcaactgagaatccgaatggggtacagttacagataatgacgagtgcagaccctacagtagctgaggatgtcaaggtgaggacgtcaagaataatccatcgcccagggatggcggcccatgcctgtaatcccaacactttgggaggccaaggtgggtgagtcacctgaggtcaaggagtttgagaccagcctggccaacatggtaaaaccccgtctctactaaaaatacaaaaattagctgggcatggtggtgcacatctgtaatcccagctactcgggaagctgaggcaggagaatcgcttgaaccctggaggcggaggttgcagtgagccaagatcacaccactgcactccagcctgggcaacagagactccaccaaaaaacaaaaaacaaaaaaaaaaaacaaaacaaaaaacaaaaaaaaaaacacacaaaaaacaaaaaaacccagaacaatctatcagaagaaggatccatgtggatgtgagattagcactgggcatttaacatgtgactgcctcaaaagggagtggtggccagtgtcgtctgagagcttcagctgccgacgagctgcctgctgacaggtgtaggaagcagaaaggtcgagcgtgaacaatgggaacaacacttacccatgggggtgacatctaaagagaaagcagcctccacccgaccctgcttcaggggaagccacgtcctcgggtcggttaggaccaaaagatgaagaatttagggatgcaaaatattttgctgataactgccaaggggatcagaagacacagaggaagaatttgggggattctgcagggttttgagcctgggtcatcccaggaaatgtacagagccatgtgaggatgagactccagtgtgggaggatgacctgggggtgtctgcctcgccacctgccatgactgggataaaatggagtaactggctcagtcctaatgatacgtaacagcagcatttttgcaaaaagagctagacctgctcataagattgagtagttcagaggtcagttaactctttctgggccagataataagtattttagattttgtgtcacaattcctcaactctaccattgtagcaaaaaagcagatatggccaggcgtggtgctcacgcctgtaatcctagcactttgagaggccaaggtgggtggatcacgaggtgaggaatccaagaccagccttgccaacatggtgaaacaccatgtctactaaaaaatacaaaaaaaaaaattagccaggcgcagtggtgggcacctgtaatcccagctactcaggaggctgaggcagaatagcttgaacctgggaggcggaggttgcagtgagacgagattgtgccactgcactccagcctgggtgacagagcaagactccatctagaagaaaacaaaaaaaagcagatatatctcacagataaaggaatgggcatggctctgttcaataacatcttatttacggttactgaacttttaattttatataatttttaatgttatgaaatattatttttcttttgattttttgttcaaacatttaaaaatgtaaaaacttttcatagctcatggcaggccaactttggaacatctgccatagattgaagacctctggcatagtttaatatttagcgggaaaagcggaaaaagagattggaaccagattagtgtggttgtcaaaaaaaaagctaaagtgtttggacggggggtgtgggtacgtatgctttagaatccattaaaaattgttaacggaggcaaaagatacgatctcattagtgttttaggaaaataggtggttgcaataaaaatgatggattggaaagataagaaattagatgtgaagagtcagcttagagaccttggcacttctatagggggacatatcaatgcctagagacccctttgcttgagaaagcataagccattgaatgttattagaaataattaaagtggtaacattgaaaagatactaaatatacaattttactttctctccgaacacactgtaagtaggaaaaagcatattaacaaaaacagcaatctaatgtcctgaaatagacctgtgaaaaggcttgcaggtaaaagaaacacaaggaagacacagagacaggaaggaaaagaatatttaggcacattaaagagatttaacccacaggactaggactcacacagtaagaatatgatgctggtaaagaaatggggcttcacacaggggaagagttcagaaaaaggactgagggttgtggtccaagatggaaccagagaatttgagaattcttttctatgacaatttcaaaaatcactttcccttcttgaaatgtatgattgacctttctgggtgaaaccctacgggctgggggaaggagaatcacctcctaggggttatacccgggaaggcacaggggagacgcattccaagtcctgaagagctcctggattgggccagcaagacatacttttagcatccttccatgacagtggtttcttgactcttttttttttcttgactctttcttaagaaaagaataaaggtacacccagaaccccattggatacctactccttgtttgcattcattagagaaaggactctcagcagtggtgaagctttatcagtaccctgcagaaaatccactgaaaccaaggtccctgcctcttagttcacgataggcacagtcctccaagcctgtttgcgcctctcttgcattctgatttactgcttgctcctcacttacctcctcctttgtcctttgctgttcaaagactgcacttgtaaattgggtaattcgagtttgatcctgggctgccctctcttctacctatactcatccccaacattagggctactaataccatctgtagtgaaaagggtcacgaagaaaataagccaaggggatatgatagagattgactgagtcaactcaggcacattggccccgatgtcacacttaagctgagatcagaatgcttggaataatctgggacatagaatttcagacagaagaaagacaaatgcaaaaaccctgttgccagttagaaagatggatgtagctggagaaaattctgacatagttcattactgcttcactgcatcactttcctggggatgggacagcacggcatgcctgaagagctgaggggctgcactggtttctttatatcgactacatcacctaagtcaacctgttctaaggcacatttggtggattctttcagctaaaaaaaaaaaaaaaagaagaagataaaatatttaagttccaaatcaaatatggtttgagtccctgatgctcacatatttactcatattgatccatttccaattacacacataaacacatttttcaaacctttctgaccattacaaaatgctggtcactacccactaattggttccaacttataatgaaaatcatagatttaaatcctaaaattaaaagaaaactatacataactgtgtgtcccacaactgcttattttatacctttttctttgcccaaataaggtggaacctgtattatttacaggctgatatcatttgttctcatcatttcagacataatataaaacaataaccagttctacaatttccctatttagactatatagaccttgtaaaacctggaggctccaatgtgcctcaatgatattttcctggacagatgtgcattttaaagtattggtttaaaatccacattatggatacaaaagacatctaaaggctgatgatatgatataaaatacatccctaaaagccaagtaattccatgtaggaagggataatattgaagtttctgaaagaaaggctttcttacaagcggtgattcttgatttgagtcttgtaaaaggtataaacttggaatgggagggtggtaaattttatagaaagggtgatattagcgaggatatcgcaaggcgtaaattatactttctaggctagaactggaatgagattgtggagttcatatctgtgcattagctgtgtcctaaatgcaaaatggcctcctggatcaaatcctagaagaaataaaaagtacatgagtggaaaagcatgatgaagaccaaataaagtctggagcttggttgacaggattgcaccattgttgattctgtattttgataaatgtacattggttgtgtaggatgttaacattagcggaaactgggtgaagtatatatggaaactcaatgtactatctttgcaactcctctataaatccaaaggtatgtcaaaataaaaagaaaaaaagaccacaccgtctgaggttgactcaaaagattttgagggaaaatttgagtgatggtctaaaacaaaatggagcaagctcagaaaatttactccagataagcccaattttagtaggtttcttagcagaaaggcaaggggtgtttggggaaagggaggttatgggaatagttgtcttagtctgttcagcctgctataaaaaaaaatttgagtaattcatatttatttattatctttttgagatgaagtttccatcttatcacccacgctggagtgcgatagcacaatctcagctcactgcaacctccgcctcccgggttcaagcgattctcctgcctcagcatcctgagtagctgggaatacaggtgcctgccaccactcccggctaatcttttgtatttttacaaaagattgtctctttagtagagacaaggtttcaccatgttggccaggctggtctcaaactcctgacctcaggcgatccacctgcctgggcctcccaaagtgctgagattacaggcgtgagccactgcccccggccaagtaatttttaaacaacagaaatgtatggctcataattctggaggctgagaagtccaagatcaaggtgccagcagatttggtgtctgccgagggcccactcctcacagacggtgccttctgtgtgtcctcataagatggaggggaaaagggctcccccacgcctcctttataaggacaccaactccattcaccagggcggagccctcaggacttaactacttaccagaggcctcttgataccatcacatcggggcaggtttcaatgcatggcttttggagggacacaaacatgtaaaccatagcaacagtccattcttaaaaagaagaaaaaatctggccaggcgcagtggctcatgcctgtaatcccagcactttggaaggccaaggcgggtggatcacctgaggtcaggagttcgagaccagcctgaccaacatggagaaaccccgtctctactaaaaatacaaaattagccaggcatggtggcaccgcgcttataatcccagcttactcgggaagctgaggcaggagaatcacttgaacctgggaggcagaggttgcagtgagccgtgatggcaccactgtacttcatcctgggcaacaagagcgaaactctgtctttaaaaaaaagaaggaaaaatcttatgaaactgccaaacataacattaacaaatcactgtcaaagtctgaggagaatctggggtctaaaaaatagccttaggccctatacttagacccactgctaaattctcacagataatcaaatgagaccatatttatatggttatagctttcatgtaaagagcacaaaagtttttgaaaatatacaacaggacgataagtctcattcttctcagtgtgaagtaccaaaaggcttccatgtagattttagattctacttagattgttttttgaaaagcagagttaaatatgccttttaaaaatcatactctactaagatatcaaattccaagtggaaacatacattactgactggtgggttattctttttttcacagaaactctaaaaatatgtttaacaagctctttaggccagttatggtggctcacgcctgtaatcctagcactttgggaggccgaggcaggtggatcacaaggtcaggagatcaagaccatcctggctaacatggtgaaaccccgtctctactaaaaatacaaaaacttagccgggcgtggtggcgggcgcctgttagtgccagctactcgggaggctgaggcaggagaatcgcttgatcgcttgaatccaggaggcagggaggcggaggttgcggtgagccgagattgtgccattgcactccagcctgggagacagagccagagtccatccaaaacaaaaaacaaaaaacaaaaaaacaaaaaacaagctctttaaacaactgactgaacttggcaaattaactttatctttacattttgtatcaggatagcaagatttgggttctaaactctgctctgtaaactaatacctatagggctttgaataaggcatttgtcactactgacttcacatttcctcatctataaaatggataataacaatccctaaggtgctatcaagatcaaacaagcatgtaaaaaggcattacaaatcatagccaataataacatggagagatttcttaaatgaaaaatacaactacagagtttgcaaaataccttaatgtaaaatactatattagaccacagtgacgcatatcaaaggagcaagatgggttcttttgttgttgtttttgtttcatttatttttttatttttttattttttatttttttatttttattttttttttattgatcattcttggatgtttctcgcagagggggatttggcagggtcacaggacaatagtggagggaaggtcagcagataagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccacccttaatccattcaaccctgagtggacacagcacatgtttcagagagcacagggttgggggtaaggtcacagatcaacaggatcccaaggcagaagaatttttcttagtgcagaacaaaatggagtctcctatgtctacttctttctacacagacacagcaaccatccgatttctcaatcttttccccacctttcccccccttctattccacaaaaccgccatggtcatcatggcctgttctcaatgagctgctgggcacacctcccagacggggtggtggccgggcagaggggctcctcacttcccagtaggggcggccgggcagagacactcctcacttcccagatgggatggcggccgggcagaggctgcaatctcggctctttgggaggccaaggcaggcggctgggaggtggaggttgtagcgagccgagatcacgccactgcactccagcctgggcaccattgagcactgagtgaaggagactccgtctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcacgcctgcaatcgcaggcactcggcaggctgaggcaggagaatcaggcagggaggctgcagtgagccaagatggcagcagtacagtccagcttcggctcggcatcagagggagaccgtggaaagagagggagagggagaccgtggggagagggagagggagaccgtggggagagggagaccgtggggagagggagaccgtggggagagggagacggagagggagaccgtggggagagggagaccgtggggagagggagagagggagagggatttttgtttcatttttttcgtttgtctttggagatggagtctcgccctgtcgcccaggctgcagtgcagcggcacaatttcggctcactgcaacccttgcctcctgggttcaagcaattctcctgcctcagccttccgagtagctgggactacagacgcccgccaccacgactgactttttttttttctttttttttttttaattttattagagacagggggtttcaccatgttgcccaggctggtctccaactcctgagcttaggcaatgtgctggcctcggcctccaaaagtgctaggattacaggcatgagccaccacgcccagccaacacttgggttctaatctgagtttagaaacttattcctgtataaagtttctttgtgcctcggggttattttaaaacgcaaatgaaattataataacagtaataataactattttagaaatttgatttcagataaaatgagactgtgcgtgtattcaatttatattagctaaatcaaatagaaataagctgaagctctaataatgaaataatgttttacaagtttaaggttaataagcatttatagataaggcatgttttcttacaatattccgttcccagggctcctggactgaagatcgaagttcttcccatggcctacggggtcccagagtctgggcctgcatagcctctccacactcgcctccactcatctcaggtccttccataactattccctctcctgtcagggaggctctgccgtccacgctgattcctgcagatcagggaaacctcccctaacttcccggctctcctatgtggctcccacagcaccacgcacctctccttcattgtgctaataatagctgcattgtgacacttacaatcatgattatttggctggtatcctctgactgtctttatttacaatgtggatattttgttctctataaattgttgcgttgattttgattcttttacatgccaggttaaaatattactaatactgattactgagggtgttttgtttacaagtgagttactcacctcaatctagttcttaccctcctgttctgacctggccattccgcattcaaaccccaggaggccaggaatacgtatccaccagggcctagaacctccgcctgtgtaggggagaaactcaaatctgtatagagtgaattaatgcatatctatagtttttgcattttaagggttttaaggaaaatattgatttgtaacacagataaaatggtcgaaatacaagtgttttaagtgaccatgatgttactggcagaagaatcactatgactaaaattccagcaatggacaacactttttctatgcataacctctttgtggtcaatttcaagacagcccacttctgtttcacggtttaattggttctcgagctcatttaggagaaattcaatttcctttgagctgagttcatatcacaacagatgagttcattcgttttggtttcttcttcaggcccatggaaaggaaagctaaacgataatgggagcaaaaataatctatggaagaggtggagtgtgaaatgtaaaattagattttctaaacatgctgtctctaatgcccaaacagagccacacccaagcgatcaaatggaatcagtggtaggggaggcgattataaatcaatctagtttatgggatgcactgtgtgaatggttaagggagtgataaagggtggtttccgacaacccaaagaaaggatcctcggcttgagctaagtgtgtgtgtttccatctagtgaggaaaggggctttcaatgacattgccacttaaaggcttacaaagaaggttctggtcaacattcttcggttcattgaagtatttcttatcgaaacccaaatgttaacatttttatctccaagggaaacaaaaaaaaaggctggtggaattcccctgtagtttctaaagaggccacagcaaggcgccatagagacagaaggagggaagttgagggaagtccttctgactggtaaatcggctttctgaccctcgtctgcaaataatacattctaaggtaaggaactaaggaagctttattgaaatcggatttcaaatggagaggtcctgctatgcctactggaggagatcagggaataataaatatttccttcattgaaaattatatcctattggccaggcgcagtggctcacgcctgtaatcccaacactttgggaggccgagacaggcggatcacctgaggtcggaccagcctgccaacatggagaaaccctgtctctactaaaaatactaaattagccgtgcgtggtggtgcatgcctgtaatcccagctactggggaggctgaggcaggagaatcacttgaaccaaataggcggaggttgcagtgaggtgagacggtgccactgcactccagcctgggggacagagaaagactccgtctcaaaaaagaaaaaaaaagagaaagaaaagaaaggaaggaaggaaggaaggaaggaaggaaggaaggaaggaaggaaggaaggaaggaaaattatattttattggccaacctcaaaattgaagcttattcagaaacagatttaaaaaaagaaaaaagtggagaactgctcccagatatatatgcagaaaagcttcaagtcaacatttaggaggtttttaaatatcgatctgggtttcgttctaatggtctgggtgtacttatacgacctattacatttcactagactgtagccaatagtgagcgttgactgaccattgctttcaaagtgagttgtgttgcctttagcaatacagtcacattaatggccagaaaaagaaaaaagaaaacaaacactgggggtgtttgaaacaactgggggtagggtggggtgggaaaggtgtgggggtttgcgttcgagtcaacctctatttcggggggtaaaaactgcctcctccgcttgatttttttcctcgatctgcaaaagcgtaaatgttttgttttgttctattgagatggagcctcgctctatcacccaggctggagcttagtggcgcgatctcggctcactgcaacctccgcatcccgggttcaagcgattctcctgcctcagcctcctgagtagctgggattacaggcgagcaccaccatgcctggctaatttttgtatttttcggtagagacggggtttcgccatgttggccaggctggtctcgaacgcttgacctcatgtgatccccccgtctcggcctcccaaagtgctgggacgacaggcgtgagccaccgcgtccggcctaaaagggtaaatgtgattacacccacgcgtatttgttcaacagacatttattgagcgctcaccacgtgccaacgccgggcgtctgggctctggaggcgctgccacgtggcggatgcgcagtgcccggcggccgggctgaggggtgaacgcgggggtcagggggccccgggctgagggtttgcgtgcgggccgggtgcctgggggccccgggctgagggtgagcgcgccgcccaggtgccaggcggctccgggcagagagtgaacgcgcgggccaggtggctccagggcggcgccccagggcggggccggccacgccctccctaaccctggcggagctgatgggtggctgtagcctgattagaccgcgtcagtccggagggtgggtcttgggagggggcgcagggcagtccacgtttccactgcagtttctcctttgttttacgtttgggaggaggtggcattggaaatagcagagtgcttcgcggtaacaggggtgagtcttgtttcatggaacttttttcaaatggggagaagggggttgtgttgctcactacttggaatgtgtcggtcaaaggggttagatagtcagggaggggaagcgtgttctcatcctgggaccaggccggagccggcctcgccgggagacttgtagccctcgccctgcggtgacccgtggctggccactggcctcaaatgttgaaaacgggcagatgggcaagtaatacactctcaagaaagcaagtgtctggcggtgatttcctaaattgcattttttattttatttcaaaacttcatgtaaatatgtttccttacaatatctggctaagtcttttctatattaacatgcttacattgtgatcaagacaccagtctcttccctttcttttcctctcctcttatctctggagatggcaatacccccaactcaaattactctagcaaaaaacctaggagactctttcttttcttttttctttttttttggagacagtctcgctctgttgccaggctggagtgcaatggcgcgatctcggctcactgcaacctccgtctcccgggttcaagggattctcctgcctcagcctcccaagtagctgagattacaggcgcccttcactgcgcccggctaatttttgtattttagtagagacggggtttcaccatgttggtcaggctggtctcgaactcgtgacctcagatgatccgcccgcctcagcctcccaaagtgctgagattacaggcgtgagccaccgcgccgggcgagactcattcttgattcctgtttcccttccgctcttcatccaatccaccggcgagctgcagggcgagggggtggttctttctcctgttttcccgctctccctgcatttcatctcctctgccgccatctgctccaaacccctggcagcccttcgcgggattcccaaatctaatagatttttctgttctccccaaatccattctccatgcagctgtccggcccatcttctaacctaaaaaaacttgctgtttgcttgttggaagccctgtaatggtttccttgggacctgggatgaaatgcaaatggtcccggggctcaccgtcagccccgcgcctgggcctcgccccagcccccaccttcctgcccgccatagctgtagggagcatggagcatggagcgtggagcgtggagcatggagcatggagcgtggagcatggagcatggcctgcagcccccggggagcgccggcagcctggaaccagcaggcttcgctcgtctcttcccacccccgtgcacttttcctcctgcccacatctggctccgatggccccctccttgggggccttttccagacattcatgatgaaggtggcgtcctcggttacttcccctctcatattcttttttttttttttttttttttgagacagagttttgctcttgtcgcttgggctggagtgcagtggcacgatctcggctcactgcaacctccgcctcctaggttcaagcgattctcctgcctcggcctcccgagtagctgggactacaggcgcccgccaccacgcccgactaattttttttatttttaatagggtttcaccatgttggccaggatggtctcgatctcctgacctcgtgatccgcccgcctcggcctcccaaagtggtgggattacaagcgtgagccaccgctcccggtcccaccccgccccgaccttttttttaatagcatttttctcaatctgacattttttgtttatttgccctttactgtctgtcccacaccaaactttgtgttaacgaggaactttgcatctttttccctaagttcagcacctagaacgaatactaaatgtatatgaagatttcgtccacatccgcttttaccagtatgttttccatgtacagtcaagttccatataaggccgtttcagtcagtgagcaaccccacgtactatggtggtcccataagattataaaagagctgaaaaatccccatggcctagtgacatcttcatgatcctgaatttgtgtaggcctaggctcatgtgtgtgtttgtctcttcgtttttaacgtaaaagtttttaaacagacaaaattttacagaataagaatataaagaaaaaatatttttgtacaggtgaaaaaatgtttgtgttttaagctaagtgttattacaaaagagtcaggaagtttgcacatttttaagtttataaagttaaaaagagtctgggcgcggtggctcacgcctgtaatcccagcattttgagagcctgaggcaggcggatcgcctgaggtcgggagttggagaccagcctgaccaacgtggagaaacctcatttctactaaaaatacgaaattagctgggcgtggtgacacatgcctgtaatcccagctactcaggaggctgacgcgggagaatcggctgaacctgggaggcggaggttgctgtgagcggagatcacgctgttgcactccagcctgggcaacaagagggaaactctgtctcaaaaaaaaaagtaaataaataaatgaatttaaaaagttacagtaagctaaggttaatttattattcaggaaagacaaatttttaaataagttctaaaatttgcctaagtgtacagtgcttataaagcctacagttgtgtacagtggcgtcccaggccttcattcactcaacactcactcactcactcatccagagccactaccagtactgtgagctccattatgggaatgtgcctacacaggtgtaccattttttatcttttgtacagtatttcttctgtttggatatgtttatatgcaaatacttactgttgtgttacagttgcctacagtactcagaactgtaacatgctgtggagatttatagcctaggagccatgggccctactgtgtaacctgggtgagttgcaggctgtgccattcgggtctgcgtagctacactctgtgatgttcacaggatgacacagcaacctaaagatacatttctcagaacatattcctgtcttcgagtgatgcatgactagttatttctgctaacagaaattggcttgccatataaatagttttcttttagtaaattaataaattaccatttcaatgttatatgtcatcctcacaagcttgtatactgctatgagaaatagcataatgctcggagatctgacaaataagaatttagcttagaaaggtaaggaccatacttgaaccttagtaaattcataaagaaaacacctctcttaggagatgcctttcttttttttctgtcacccaggttggagtgcaatggtgtgatctcagctcactgcaacccctgcctcccaggctccagcgatcctcccacctcagcctcctgaatagctgaccaccagcacactaggcaaacccaccccactcacggcctcccttgggaattcagacctaaccatcgctgagctgaagtgtaggtgtggtctgattagactcattttttcttttttgtagagatggggtttcaccgttttgccgaggctggtcaccaactcctgggctcaagggatccacccacctcagcctcccaaagtgctgggattgcaggcatgagccaccatgcctggccttaggaaattcctttctatgtaacaccctgcatcattaatagccagcttttttgaaacttctacattaaattgtctaaactctcaaataaattcctagtaaagtaattatatagggttgttaaatcagagatcaacagcacaatgactaatgcatactcatgatttcatctcactagacaaatgtactgaggctggagcctgtgtgaacagaacagaagaggccttcactctagtagtgctcacagtccagcaggtaagacagacttgaagcaagggacaccagagctctgatcagtgtgaaatagggagctaggagaacgtttagctttgggactcaactgagctgaagaatccagggaagcctgcctgaagaggtgatgtttgcgcatttgaagtatggatgggaagcaagcctctgtgtgtgtgttggaggataggtggtattttagtgagaaaaaagaacatttgtaatggactgatctgatgctttactggagaaagtttattatggctgaatagtgaaatacaagagctatagatggcaggaggtgagcttggagggaaaagcagcagtcaattaaattgcagttacaggttgagtattttttatccaaagtgcttgggaccagaagtattatggacatcagatttttttgaatgtttgagtatttgcaaaatacccaatatgagcatcccgagtccgaaaattcaaaatccaaaatggtccaatgagaatttcctttaagtgtcatgatggcactcaaaaaggtttcatactttaagcatttcaggtcctagattttcagatttgggatgcacaagctgttttttaaatggactaattggggagagcagctctgtgtttaatcctagtaattaccctccaaaggtgctaatattgtgcttcataaatattttgagatctccctggttaatttcacctctatatttttgttttctttttttttcttttttttccgagaaagtcgctctgttgtccaggctggagtgcagtggcacaatcttggctcactgcctccgcctcccaggctcaagtgatctcctgccagtagctgggattgcaggtgtacgccaccacatccagttaatttcttgtatttttagtagacagggttccgccatattggccaggctggtcttaaactcctgatctcaggtgatccgccagccttgtgctcacaaagggctggcattacaggcacgagccactgcacccagccctaatttcacctttttaaaggacacaggcctggcgcagtggctcacgcctgtaatcccagtactttgagaagccgaggagagcagatcacctgaggtcaggagttcgagaccagcctggccaacatgatgaaatcccgtatctactaaaaaataacacaaattagctgggtgtggtggcggggcgggggggcgcctgcctgtaatcccagctacttggggcctgaggcaggagaatcacttgaaccccagaggcggaggttgcagtgagctgagattgcgccattgtactccagcctgggcaacaagagcgaaactccatctcaaaataaaataaaaggacacaaaaaataacattagtagcatataacatatatgtattacatatttttaaatacattttaagaaatcttaaacttttcccctacagttggaacacattttgtttttattatatgtatttgttttttaccaaaagtaaatgacatgcttctgttgaggtgttttttttttaatgtggttattttaattttcatccaacaacttttacctttgcctcttttttaaaggcatataatttttcttcctacagaaagacatcaggacaataaatagggagatcttttctcaggcacacaattgtaacattaagtaagagacttttatagtcaaagcaataacatattcatgctataacttttataacgtcattgctgttaaatgtttaaggaaatgataggaaagtcttcagggccaagctaccccgtgcctttattttggcatggattcctaaaagtgggagcaccattaatttcatgtgtcttattctctggatccccattttttagaacaatgagtgggcacacgatggcccatgggccagtctccctgttttactggaacacagccaccctcattcctttatgtgttatctgactgcttctgtgccgtgctacaacggcaaagttgaatagtttcaacagacaccacaggacccacaaagctaaaatctggccctttgcagaaatagtttaccaccccagtctagaaagaacctggcgtgtagcaggatgcaacatatacttgtagaatgaataaaaaggtaataaaataacacgagctcacatagcggccagcatttgctgtgcaccataatccgtgctaagcactttgcatgcgttatttaatttgaatttcataacagtattacataagaaaacaatagggccaggcatggtggctcacgcctgtaatcccagcactttgggaggccgaggcaggcggatcacgaagtcgggagctccagaccagcctgaccaacatggtgaaaccccatttctactaaaactagaaaaagtagccaggcgtggtggcgtgcgcctgtaatcccagctacttgggaggctgaggcaggagaattgcttgaacccgggaggtggaggttgcaatgagctaagattgcaccactgcactccagcctgggcgacagagtgagactccgtctccaaaaaaaaagaagaaaaagaaaagacagtattttgctccctcaccgccttcaggcttttaaccaactgccacttaccaccctagtgaaggtttgcccgagtgccctatttaatattgcaggcttctgtttcctaccagcccctttgcttactctttcacacttagtcaccttctaacgtggcatacattgcttattttctatgctcatgagtatgtctactccatggaggcatagatgtttgtatgcctgtttactgatggatcacaaactgtgtagcctaaaatagagctagcacatagtcccacccaacacgtgtcaggtgagcaattagatatagagggttccaataacttgtggggacacccagataagatctgtttatgactcatgtcttacacagagctcattcttggtctcttggttagtttatcagagaagacaaatgtattattggaaaatgtgtcttaggtcattttttgacagtggctctaatactggaatctattttaactaaaggttattatcataaagcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaagacctgcaggcggaaatagaacctgtcagcgcggtgtgggccttatgtgatggctatgtgtgctatgagcctggccctcaggctctcggaggggatgatttctcagactgttacatagaatgcgtcataaggggtgagttttctcaacccatcctggaagaggactcactttttgagtccttggaatacctaaagaaaggatcagaacaacagctttctcaaaaggttttcgaagcaagctcccttgaatgttctttggaatacatgaaaaaaggggtaaagaaagagcttccacaaaagatagttggagagaattcgcttgagtattctgagtacatgacaggcaagaagcttccgcctggaggaatacctggcattgacctatcagatcctaaacagctcgcagaatttgctagaaagaagccccccataaataaagaatatgacagtctgagcgcaatcgcttgtcctcagagtggatgcactaggaagttgaggaatagagctgccctgagaaagcatctcctcattcatggtccccgagaccacgtctgtgcggaatgtgggaaagcgttcgttgagagctcaaaactaaagagacatttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttctaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaatttgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcaccacgcccggctaatttttgtatttttagtagagatggggtttcaccatgttggccaggctagtctcaaactcctgacctccagtgatctgcccacctcggcctcccaaagtgctgggattacaggtgtgagccactgtgcctggccccccacaacatgtttaaacttagctaggcctggttgcatacgcctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttcagaaatatgccaagtctgtattttaaaaaatcaaagtctacattgaaaagagataccatttatttgttcttaaaacttagcaaaattcaacagactgatgttcggtataggtgagatatggcgggaagttgggcttacgtgtggttggataagggataaactgtcacagccagtttggaaataaattttgtaattgtgctatattcgtttttgagctgccgtagcagtactcccaagctaggtaacttagcagaaatgtattgtctcggttccagaggctagaggtccaaaacccaggtgttggcagggttggttccttctgaggctgggagggaaggactggcccaggcctccctttttggctttaagtgactgtctcgtgttcacatggcattcaccctgtatccccacatcccttcactctgcctgtgtccgaacagggacaccagtcatgtgggattatcacccgtgctgatgacctcatgttaacttgacaaactctgaagaccctaccttcaaataaagtcacattctgaggtactgaggttatttgtactaatgtacaaagggatctgttcaagaatgttaactgaatagtatttttaatagtgataaacccataacgtaaatgttcattaaggggatatgggctgcataattcatgccacttttgttcaacagcaaatgtgcaagtctccttcagggagagggtcacagctggaggcaagccacaaagaggaagtttcttgttactaacagatgagacgggatctggtgtattttcttgctgtggaaggaaattcagagaaagtagttacatacggataaagggagaaattgtctgaaggtagctgatctaatgtaggggttaactcatttttatcattattaagtgaatccctgattggaatcatctcataatggccaaaaatatgctgccatcaaacttgaaatgcttatttgattttaagatttaagacatctctggaggtagtgctaagtgtaccattaatttaatggcttttcaggaaataacaataccacactaagtaaatatatcaaacttaagattaatcttgatttctaaaatgccaaagtctaaaatatgtctttaaaacaagtaaaaaaaatcaaaggcttacattttgacgtcagtatgagctaattgctactatggactatggaaattacttcttaatttggtctagaatttctagtatcatttttacaggaatgtgggtactgagtgaggaacactgggtacataatccatttgtaagtggaatttcctccaaatcaaacacctgagtatagaacttgagatgggaatttggtatttgatcaagatgacaaagcatattctcagctagttttgctttcgtagcactgtgtttgatttgctcttctgtgggtttctacttcagagatgaattagcacagagcacctctgaagaccaggcaaaaggcaggactgaatagcagccctcaaggccagaggaagtcaggggcagggtttaggctgcaagctggagagccgagatgcagggcaccgagagggatggatggagatgcttcttcctgaaccatgagcatttctaaaaggtagatcagcctttacatagcgggagccagtctccatccctcttgctgttctcagatggctgttcctgttcagctcttttctagagctgaagggtccgaaactccctgttaacaactctaaagcttaaatgtgtaagaaacagcaatctgagaaaatgcttgtgtatctggatcccaaggcttagttaaatcctgactgaggaatagggtgctacttagctagcttcctagctgttcttgtttttgcttttcttccaaaaaggaaccctaaaactgctaagaatgtaagaggatgcatgtggatgcaatgtggatgtaagatgcatgtggatgcaatggaaacaaaaaaaaaaaaaaaggaaaaggaggttagctaatgaggatatatgaggatatgtcacctgaaatcctttgtttatggttcaggaagaaatgtacatagactctccacatttgtgttttaagtaagaacgaacacaagataacctgaacacatacccagagaaaactgaaaaaaagtctcagttcatctagcttttcacctttccaggcactggcatttgacagaccccaaatcctgataaatgaataaaatgtttttcggttttcaagctggcatttggcttcatggcccataaacaacaaacagaatcttacatgtgtagggttttttacattttttatcatgtttgtttaagatgtatgtgctgggccaggcgcagtggctcatgcctgtaatgccagcactttgggaggccaaggtgggcggatcacctgaggtcaggagtgcaagaccagcatggccagcatggcaaaactctatctctactaaaaatacaaagattagcctggtgtggtggtgcgcacctgtaatcccagctacatgggaggctgaggcaggagaatctcttgaacctgggagggtgaggttgcagtgagcagagatggtgccactgcactccagcctgggggacagtgtgagactcttgtctcaaaaaaaaaaaaggtgtgctgttttgatatgcatatagtgaaatgattactgtcaggaaaattaacccatggcctggcgcggtggctcacgcctgtaatcccagcactttgggaggccgaggtgggcagatcacgaggtcaggagatagagaccatcctggctaacacagtgaaaccccgtctctactaaaaatacaaaaaattagccgggcgtggtggctggtgcctgtagtcccaactactggggaggctgaggcaggagaatggcgtgaacccgggagacggagcttgcagcgagctgagatggcgccactgtactccagcctgggcaacagagcgagactccgtctcaaaaaaaaaaaaaaaagaaagaaagaaaagaaaattaacccattgtcccctttttcagttatcttttgtgtgtgtagtaagcacctaaaatctactttcagcaaatttttggtaatgaatactacattattaactgcttcttcatgctgtgcgttaggtttctagacccatgctatctaactgcaagcatagacccttgtctgttgctccctatttctccctcctctacctctgcattcctggtcactaccatttctgcgctgtttctatgtatttgccttttttgtttgtttgtttagtttccacatatcagtgagattatgtagtgtttttctttccatgtttggtttatttttccagtttatgttgtagcaaaggcagttatctccttttttaagtctgaataatattccgttgtacgtatgtgcaccacgatttccttattcatctgttgatggacatgtggattgtttcatttcttggccgtggtgaatgatgctgcaatgaagatggacgtgcagatagcttcgtgcggtggtgatttcatttcctttggctatatgcccagaaagggaattgctggcccatatggtagtcgtacttttagtgttttgaggaattcccatcctgctttccacaatggctgtactaacttactttcccaccaacagtctgcaagaattcacttttctccacatctttgtcaacacttgctgtttcttgtctctttgatagtggccattctgacaggtgtgagggagtgtttcactgtggtttggtttgcatttctctgacaatgagtgccgttgaacacctgttcatatatttgtgtgtcttttgcgctatgtctgttcaagtcctttgcctttttttttctttctttttttttttttttttttttttgagagacgaggtcttgctatgttgttcaggctagtcttgaactcctgacctcaagcgatcctcctgtctccgcctcccagagtactgggattacaggtgtaagccaccatgcctgaccctttcaccatttttttaatcaagttgtttttttggggggtgagttgtgtgggcaccttgtatttttttaatattaactcctatcaggtaaatgatttgcaaatattttctcccaacccataggctgccttttcattttgtggatgttttctttgccattcagaagctttctagtttgatgtagccccacttgctaatttttgcttggagttggtttttgtgtgtatggtgtaagataatggtccagtttcattttgcttgtgaatatctagttttcccaataccatttattgaagagagtgccttttccccattgtgtctttttgtttttcttgatgaaaattcttatatatgcttttgggttaatttctgggttctctgttctgttcctttcatctgtgtgtctgtttttatgctagtattgtaatattttgattactgtagctttgtaatataatttgaaataagggaatgtaatgcttctaactttatttttctttctcaaaatgttttttggctattcagggtcttccgtggttctaagcaaattatagaattgcatcttctgtccaggcatggtggctaacacctgtaatctcaatactttgagaggctgagccaggaggattgcttgagcccaggacttcaaggttacaatgagctgtgatcctgccgatgctctccagcctgggcaatagggtgagaccccttctcttaaggaaaaaaaaaaagaaaaattaaataaaaagattcttttttcattagccgggcatggtggcaggtgcctgtaatcccagctacttgggaggctgaggcaggagaattgcttgaactcgggaggcggaggttgcagtgagctgagatcgcgccactgcaccatttctgtggaaaatgacattggtattttgataggaattgcatggaatctgtagattgctttaggcgatacagacattttaacaatattcttccaacccgtgaacataggatatctttccatttatttgtgtcttcagttttttcagcaatgtttacactttctggcatttgtatctttcacttcctctgttccatttattcttaagtattttattcttttggattcattctaaacgggactgttttcttggtttctttttctgatagacagtaactgctgtaaagaacgacagctgattaaaaaactgaaaatcttaaggcagagtccactgctttcttggtatcactaatacaggcaataggaggcacttagtaaattatggaatgaataaatgtaaaaatggagcttaatatgctttaaaagtaccttaataaaattatcaaaattaaattaaaaatataacccaaaatggccaataaggaaactgttactgttttgttttgttttttttttttttttgagacggagtctcgctctgtcaccaggctggagtgcagtggtgcaatcttggctcactgcaacctccgcctcccaggttcaagcgattctcccgcctcagcttcctgagtagctggaactataggcgcatgccaccacgcctggctaactttttgtattttcagtagagacggggttttactgtgttagccaggatggtctcgatctcctgatctcgtgatctgcccgcctcggcctcccaaagtgctgggattacaggcgtgagccaccatgcccagccgtgttacttatttttatataaaatatgaatactctgaaataaaggtaagcaactttaatagactaacatattctcactaaaagaaaaaaatgtgtctgtgtgtgcatatacatataacacatgcacacatctattcctgttttccaaaagtaatctccactaagagttcttcaattattttgtttgatcatcttcattaatagtgaaaataatcttaaatctcattatcattcctttctgccttccttctctgtaagaggcaggggactgagggtttgttcatcttccagcatcttgaataatgaagaactaaccagtatgaagaattattaccaagactgtattcgatggtgatatcacttacattcctacttgttcaaatcagttgttttataccgtgcgatatgtgcacagctctcccagtgatatctgactcctgtatttcaccacagctacaatatacatttgtggacataggatttacagaattctatctgaaagcaaatttgtcaggttgttatattgttgacaaatactcttgtttctcagatcattttttgctggctatatgcacgtgcaggaatctgtatgtgcttgtgttttaattacctaatgcactggctctgactgaataaattgcatgattacctcctacactggacacagaacagtgcaagtcatattaaaaagccattatatttgcaactctgagcaagagactataattaaaaggcagttggatgaaattagctttgagagtacaagagtttaagcaagatttggtaaatgaacattaatggttaacatgtggtttttattaggtcttttgcttcttctctccataaccccggagttgaatttcttagatgtcagtggaccagacatgtgagaacacctgtacaaagctatactttaccatgtggctaaaattatattcataaaacaagccaacataacttttgtgactttagtaaatcaaaggtattagactagaatgatcccctgggcattaataaactattcttaatgctcctaagattttagttatatgtcattaaaagcatactgtgtgctccatgcaacttaaaatgtttgtcataaaatacacatatacacgtcaaagaagtaataaaacttgagggcattttaattattctcaccgttaaatataaaaaagttaaagttgtatgcagtatgtgtaatagcatcccattcttatctgtttgcagactgttgaggactccgcatggtagtgatatttttgtagaggggaaagctttatggagtatgtgtatgtactcaataggtcttacacttaggcagattaaagatgcctgcaaattctggccgggggcggtggctcacgcctgtaatcccagcactttgggaggctgaggcagggggatcacaaggtcaggagatcgagaccatcctggttaacacagtgaaaccccgtctctactaaaaatacaaaaaattagccgggcgtggtggtgggcgcctgtagtcccagctactcgggagactgaggcaggagaatggcgggaacccgggaggcggagcttgcagggagccgagatcgcgccaccgcactccagcctgggcgacagagcgagactccgtctcaaaaaaaaaaaaaaaaaaaaaaatgcctgcaaattctttgctacttctcccagtgagagtaggggtctatttccttccccttgagtttgggctggtctgtgactgctttgatcagtacagtacagtataatgtaaatggtgctgcaatggttatgccaattccaggcttagtttgtaagaggccttgctgtcttggaaacctactgctagtttgctgctgccttggaaaccaactgccgtttaagaagcatgactaccccaagaccaccctcctgggcacaatccaagccagccacaggcagaggccctgtaggataagaaatcatgtggagagagaagctaaggagcaatgaggtgctgggcttgcaagtgaagaaggcgactggaaaagccatctagcctggatcaccccaggtgacgccacaggagttggtccctttccaagtttctaacccacaaaatgatgcacagtacaaaaagattgccttaagccgcttaatttcgggttagtttgttatgcagcaatgaattacatacaccccacttcaggcttgtttttgaattttatggtccctgctttacatgtgtgtgtatacgtgcatacatatatatacgtatagagagattgtcatatgactatatacatacgtacatatatacatatagaaatagataagattttgtcgtatatctagttagtgcccaagttcaaaaggaagtctttatatttctaggtttatatactagatttattttcagccatatgacaatgaaatagtgagttccctcttccttaaacattaaagactgattctatttggtggggtatctaaggaaactgcagctgcctttagtttactaaaactcagtctctaaagattggtggagggagaatctccacttgggaggaacagtttttcttcacggaaccagttctgaggctgggcctggtggctcatgcctgtaatcccagctctttgggaggccaagatgggaggattgcttgaggccaggagtttgagaccaacctggacaaaacagcaagaccccgtctctacaaaaaaaattaaaaattagccaggcatagtcccagctactcaggaggctaaggcgggaggactgtgcaaactcagaagttcgaggcggcactgagctatgatcacaccactgcaggccagcctggatgacagagccggaccctgtctcaagaaccggtcctgccacctgggtgggtcaccttcttggaggaatatcattaattgctgtcaccacaagcactgtccttaaagggccatgctgcacttcacactctgacccaagcctgagcacctagctctttctttatttcttagtaaaactgagatgaggttggaacatgtaaaggcctctattaacggcaagaaaataataccgcttggattctcaggccacaggcttaagagaggtgcacctgtttcaagatctagagttaagaggctccaatggttcatttctatctgagacctggtttaggtttctggctgggatctaccttactcagtattctaccttacccggtatgtctcactgacctcttcatgaaagtttatctccacgcattgtgtgacttcacatttcacttaacacgctaacaacgtaaacggctcaacagccccaaaacgtagataagaaatgaatacattctttatgaactttttctgtaaatctgctggcgggattaaagtattagatagagtatttaactagaagacccctctaaagttacccaagatgggaatagagaatgaacaagagagagaactttgcccctggcaaggggcagttttgcaggctttgtaacccatcgtaaagggttagaactttgccttgtagtcaataaaggaagcatagaagggattaataagcaagtaagtgacatgatcaaattcactctttagaaaattcatttagggtgcagagttaaagatggattgggagaaggaaaagatgaagctgttgccataatctagaggtgaggtgacatgtctttctggacttagtttccagcacaggcacagagcacagtaagtgattatagatgtttgaatatatgcttgactagacaaagctaaaaggatttccaagcagtagtaaacatagaaaagtgacagatgcactaaacttaaagtcagtgacacacaacaatcaaaaggtaaatacacccatttaaaatgggcatagggcttgagtagacatttcaccaaagaagacagaaaaacaaccaataagcacgtgaaaagatactcaacattattcatcactagggaaatgcaaatcaaaaccaccctcagataccatttcacactctcaaggctgcctataatcaaaacaagaagtattagccagatgtggagaaatttgagccttcattcgctgctggtgagaacgtaaaacagtttaatagttccttagaatattaagcatcgttacataaaccagcagtttcactcccaggtgtataccaaagagaaatgaaaaaaatctgtccacataaaaacttatatatgaatgatcataatagcataatacataatagccagaaagaagaaaaaatccaactgctcgccaactaatgaataaacaaaatgtagtgtgtccatacaatgaaaatttcagccataagaaggtagcactaatacgtgtgataacctggataagccttgaagacatgctaagtgagagaagccagacacaaaagtacccatattgtaaagtagcatttatgtgaaatgttcagaacagacagacccaaaggaactcaaacccaaagagttccccaaagaggttagcagttgccggggcgagggcgtggaggcggtagggagtggccgctcatggtactttttgtggcatgttaagaatgtgctgaaattaggtagtgtcagtgattgcagaactctgggaatgcagtaaaaaccgctgagttgtatactttgaaagggccaattttatgacatgggaattgtatctcaataaagctgttatttaaaaaaaccatttatgcaaacttttatagacttcttaactattttacagtcactttcatcagaagtaataacgcaaaaattcaaacacccaggaggttacacattctgtgttaagaacacagactttgaaatcaagcagactgagtggaaacccagttccatcccgtagaaactgtgtgacgttggacaaatgacgtaacttctctgaacctttaatcatctctaaaatgtaaataatacctatcagacatgttataaaggtgaaatgagacaacagagaaaaaagtcctaagctaaagtacggacatgaattattatccagggtattgttattctttactgtgccaagacaatgacccagccccctgaaggtattacagttttatagcacattctaggtggttgacataaattgccatgtttatgtttccttagtgagcacatatattaacgtttgaaaagtatgttgaggccaagcacagtggctcaaacctataatcccaacactttgggaggcggaggcaggagcatggcttgaagccaggagttcaagaccagcctgggcaatataacaacaccccggttctacaaaaataaaaaaagtagccgggtatgggggcacacgcttgtagtcccagctacttcggaggctggtagaaggatctctttagcccaggaatttgtggctatggtgagctttgattgtgccactgccatccctgcctgggcaacagagtgagccctatctcttaaaaaacaggtggggcgcggtgcctcatgcctgtaatcccagcacttttggaggccgaggtgggcggatcacgaggtcaagagttcgagaccagcctgaccaacatggtgaaaccccatctctaataaaaatacaaaaattagctgggcatggtggtgggcacctgtaatcccagctactcaggaggctgaggcaggagaatcgcttgaacccgggaggtggaggttacagtgagcagagatcatgccattgcactccagcctgggcgacagagcgagactgtctcaaaaaaaaaaaaaaaaaaaaagaaaaagaaaagaaaggaaaggaaggaaggaaggaagagtgcagatgctgggaggcgccttgcactaaggcggctttcatactgtgcgtaggagcttcggtttctcacatttagaacctaaagccattgaaggtagagctctaatattttgtattattttttaaattgctcataagaactgagctcattttcaagaaatacctcaacctataaagcataaataaaaggcataagcaccaaaaattcacgagctctaaggaaccattctggtgaatgcattcttcaaaaaagtagtgcgtttaatcagaggagcagtaagttcaggtttgcatgctgtatctgacacctttgtgtggcccgtggatataagcagatgtgaagcagaaaagagggaaagactggagaattgttggtttggaaataagaaatatggaaagcctggaaaaagcacagttgtcgggataaggaggagagaggaggaaggacatgtttgggttaagtgatcaagctggggccgtacgcggagtgagggagggaggaggaggagcagacaggcaggaggatcctgaggtattcagcttgctggagtgaatggattgagatgcggttgaaggagatgggaactgggaatgcaggaagagaagccagaaggggagactgcatgacagttcggctgaagataagaattattctgaaatggcagttgtgcatgttggaaaaataaatcaccatggaaatgagcctgatcaaatttgactagggaaactgagagttgtacagaactctcattccaaaatgttatcaagtccttaagataatttaactctgtgttgcaaaataggtagacataaacagagaggaaaacagtattttcatacagaacaatgaagaggaagtactagatttaattggacacacgcttctcacatttaaagatggggaggagataatggtgtccctttgtgtccttcccaaagaaatatggggaactgataatgcctcacataagtcttaaaggaagaaaatgtagagcatgcacttttgcagatcactctctcattaacaaacaagctcagaagaaatgtggtctcaatgaaatgcttcctttcttggagcttaaatacggtcaaatctaaatatctaagaaatcaggaagtttgacatctttaaccactaaagattaagacaaattttttacatgtaaagttttatctggatatagggacttcctgatcaaggaaatagttgaaaggaataaaaaaaaacaactgagtcacagaacattccatcaatgaattattgtccaggtttgttcagaagtggtgacactaatattattttgctcaaagtaaataaactgcattgctgactacataaagagagagaagttgtacctttttgcttacctctgttttcccgatgcctagtgtaagttgtctagcacgtagtaagcagacagaaactaactacatatgtggaatgaatgtacgtgggaaagatcaattctgaaacgtgtatagacgagaagtaacaaatattcttaaaatagtacaagaactcatcattcattcatcaaattcgttttaatataaattctttattgaaatattagagacagaaaataagtcataaatgctcttatattccccttacctgcttccaaactttaccttccctaccgcaaaagataatctttctactaacctctaacgccatatttgctgttgatggcatctgagaagtctccagttttcagctattactaacagtgctgtgatgaatattttgtttttttggttttattttgttttagaggaggggtctcactgtcactcagacttggatgcagtggcatgattatggctcacggaagcctggatctcctgggcttaagtgatcctcccactttagccgcccaagtagctggtactacaagcacacaccaccacacccagctaatttgaaaaaattttttagagatggggtctctctcgccatgttgcccaggcacatcctgaattcctgagctcaaatgatcatcctgcctcagcctcaaaacgtgctgggatcacaggtgtgagtcaccatgcccagcctcttctgtatataactagaattgcccgttctttggatgtatatatgatcagctttaaaggatatttttgaacagttttccaaagcaagagaggaaattcctctaaagcattttcttaagtgatgaataggagctttctaatgcattctttgccgttttcacagtgtggacattgacattcatggtgcaaaagcaatgatggataaaccagttggtgccttagaacgaatcaagccagtggcaccaaactgtcttagtagtcattacatactagtagtcactgccatgtatcaaagcaaacaagagccagttttattttttgaatgtcttgatgatgtcggtttaaaaataaataaatagaaattttaaaacttgaaatgttttaatgaagcactaaaaagagtcagttttactacatctcagcccttgagttcacattattatgaagtattttttaatattttctctggtgaaacggacatacgcataaagcgtatctgttgcatgcccaagtacccaagtacaacaaatgtatcaaagaatagaatctatgaaattggtggacttgagagctgacttagctgatttttttcatggaacataaattttactcgaaagaatgacgaagatgctgggtatggttattcagattggggtgtctctcaaaaatatacagacatactcttagaaacaagtgaaatgggcctgtgatctcaaagaaaaaactgtttttggtcagggatagaatttgagttttcacaagaaaactagaaattttaaaaattttaaaaacttgaatctatcactgtgaacttcgcagcttgcccgtactttaaaattttctgataagattatcatgttgttttatgaatataatttttcaacattatctactgaaatatgtcaacatttggaagatctgaataactcagtgaaccaatattttcaatgtatcatattacaaaattatacatgaggagagatccattaaaagtgcaagagataggccaggtgtggtggctcacacctgtaatcccagcactttaggaggccgaggtggttggatcatgaggtgaatagatcgagaccatcctggctaacacggtgaaaacccatctctactaaaaatataaaaaattagtcaggcgtggtggcgagcgcctgtagtcccagttactcaggaggctgaggcaggagaatcgcttgaacccaggaggtggaggttgtggtgagccgagttcatgccactgcactctagcctggcaacagagcgagactccatctcaaaaaaaaaaagacctacacctgtaaaggtttggtgtagattcaaagagtatccacaggtatctgaaacagctattaaaatactgtatgaggctggcttttcttcatatacttcactcagtcaacatatcaaaacggattgaatacagaagcagatatgagaatccggctgtcttctgtaaatcctaagtgacagttccattgtcataaaagaggacacatagaataatttttccagaaactccaaggtcaaaatctatattttaaatgtgcctaatgtacttctaaagtaagagttcttactttgattagttaaatcagaaaaaatttttattcatattcaaaatagtataaatatataaaaatgttaaaggcatagccaattattgatcacagaagtgacatgatacagtcgtttgttacaaatctgagtgattatttacaaatctttagagttgttgtctgataggactcagtacggcagttggagtgtagctgaaagtaggataaagcaggtggatatgtgcagatgatagaaatatggagatggtagaatcaataataaaaatatcacaaaacaagctccgtgatcctactttagctgttaaacttttgttgttgttgttgttactgagacggagtctcactctgtcgcccagctgttctcagctcactgcaaccttcacctctggggttcgagtgattctcctgcctcagcctcccaagtagctgggactacagggggggcaccaccacgtccagctaattttctgctaaactttttgaaatgagaggcccatggtaaagtagatatcaacataaggcttgttgagtgactgattaattctagattattattctcatttattggcacaaaaacaattacacattgctttctatttggctcctctggtgcccttaccaccactgcacagttcctacatatgccgtgattcttaacctttggagcttgagtaattacccctaaatccctctcttaaaaatcttgggggccaggcacagtggctcacacctataatcccagcactttgggaggccgaggaaggtggatcacctgaggtcgggagttcgagacaggcctgaccaacatggagaaacctcgtctctactgaaaatacaaaattagccaggcttggtggtgcatgcctataatcccagctactcaggaggctgaggcaagagaattgcttaaacccgggaggcggaggttgcgggttcaagcaacctcaagcctgggcaacaagagcgaaactctgtctcaaaaaaagagaaaagaaagttccttggccttttcttgtgtttcttgaccttgacattttttgaggagtccaggccagttattttgtagaatgtgtcagtttgggtttgtgcgatgtttccttgggattagattcaggttgtgcatttttggcagaaatacaactatagtgatgttgtcaccttcaccatgcatcgaatcaaagggacatgatggcgatggcttccaaggtgatgttctctttgagcacttggtaaggtggtgtctgcttaatttctcgacaggcaagttactgtttttcctttgttattgataagcaacttctgggggatacttggagactacgcatatatcctgttctttatcatgctttcacccaatagtacccactgatgaacatattgtgtatacatgaaataataataaactattatcactgatagaaggaacatattgtgtatacatgtaataataatgaactattatgacttcttaaagcaggttgttcattgtttcctgagtataaataaatcagaaatgaatggctttaattttctgtaaaatatgtttacttagaaaataatagaaaatgtcctttacaaaatgagttctagggttttattgaacaaaatgtgtttgcaaaacactgtggggtgaaaagagtatgaccccttacttccccatcataacgctcctggctgacactcccgtaataaaagacaggttaacaagagaaaagcataacatatttatttgatcaaagtttttttttacgtgacaaaggaaccttcagaaatgaagccccagaggtccccagaaaactgtctgtttttatgcttaggctgggtgattaggggacatctttgtagaaatgtgagtgaacaaaaggggaagctctaatgctaacagactgagtgcagacacccagcaaggcctgtctgttcagattcttctcagcctctccctgcagcatgcagcatcccttcctcctgggtatggggcagggcccttctggaatgcgggtttatgacctccgtgcaggcaaaatagaccagatagtttctttatggccaactcttacacagaaaggcaggggaagattggagtaatttttttttaggttttaaggctagctttcagggagaatggttctggtttctatggacttgccttggggaagagggattttagtttccttgtttgtttgtttgtgttttgagatggagtctcactctgttgcccaggctggagtgcagtggcacaatctcagctcactccaacttctgcctcccaggcttaagtggatcttctgcctcaacctcccgaataactgggattacaggcatgcgccaccacagccggctaatttttgtatttttagtagataccaggttttgccatgttggacaggctggtctcgaactcctgacctcagatgatccacccgcctcggcttcccacagtgttgggattacagacatgagccaccgcacccggccctagtttcctagtttctatggtcggccttgggggagaaagtttagcaggaggaggaaggcgaggagaaggtcagaaactttgcttctgaggccctccaaggccctcccaggccctttgctccaagtcctcagcaagccagaggacgtcttctgagcccaacaacagtttaaggcattccaaaattagaagagcaatcaggcacccaaccatactaaaagcgtgtttatattttcgcatattttccaatccattgaacaaacaagcaaacaaacaaaagaactggtgtgtagagtgaaaggagcgttagtgtgtataatatctgtggacagaatagtcgtctgaactgaatctacagcaaaactacaaagctgtgatattgtgactccgagaaagtgcagatttcatattccagtaagatttattgaatgcccgttgcctgctaagcatttcatacataagcatattcacacacagcaccttattttgttatcataactctatagggcaatggtattatgctattcttccactcaagagaacttttcagaggttcatttacttaacaaatcataactgccacatcccaggtgctttgttaagctctgggaatgcaacctggaagaagacagatctggttcctctcactttctaagcccagttataacatgctgggcccatgattttactcaacagtaaaatcgaggtttacgctgtgtgctaagagaggcatccaaaccaaacgtgtggactcaggggaggctttgctgatggaacttctaattaggctgggaaatgaaagacgacaggaagctgggtgaggaggggggatggtggtggagggaggacccaaatattccaggcagagggaacgttgtctcaaaaaaataaaaatagaaataaaaaaggcttctgttgggcacgatggttcaagcctgtaatcccggcactttgagagggtgacgtgggcggatcaggaagtcaggatatcgagaccatcctggccaacatggcaaaaccccccatctctactaaaactacgtggtggcacatgcctgcaatcccagttacttgggaggctgaggcaggagaatcgcttgaacccaggaggcagagtttgcagtgagccgagatcacgccactgcactccagcctggtgacagagcaagactccatctcaaaaaaaaaaaaagaaaaagaaaaagcgcctcaggctgtcccagcattttcattcaaaaaggagctttgagagacagccaggtggctagtgacgggctagcagaggcagagagggctgcaccttttctaccacagtttaacattgctcagagattgcgtgtctaacctcaggaaggttttgacatagtttacactgattttactttgttcacttcaggatggaaaggatggcagagtctctgctgcatccaggatagtatgaatcattaaaatgctgaaaccactttcagcagtgtattctagtcctggccggaagtcactaacctagctgaaacatcaaatattatggtaatttggtctgagaataaataatagattatgttaatacagacagggatgagataatgagaaacaggctacttaagaagcatattgagtggtttatttgtgaatcaaaaagaagcaaggaaattgcattaaaagaaaaactgaccctggagtcactcttttaggtgaccttaatattccataaattataagttaagataaatgaaacaaaagctctatattatgaagagtgaaattattttgtaattctgacagaaaactaagtattctaacattttactgaagaaaagcctgttgatcattctcatttcccgccacagaacacgtataccctttgccaacacttactgagcagttactatgtgcggttactaaggtctaatgttttgttttgtttttttttgagacagggtctcactctgttgcccagactagagtgcagtggcgtgacctccgctcactacagcctcaacctcccaggcttaaacaatcctcctgcctctgcctcccaagtagctgggaccgcaggcacgccatcacacctggctaatttttctacctgtttagcaacagggcctcactatgttacctaggctggtcttggactcctaggctcaagcgatccacctgcctcagcctccccaagtgcagggattacaggtgtgagccaccatgcccagcctaactctttacatccacgcatatactaccttaaacatctttgccatgcgagaatgtagataccacttgtatagattgggaaactgaggcacatgatggttgaataatttgccagaggaaacagagctggcaggctgaagggcttcagaccaaaacttctctgacctcatttggtagcaaaacatatgcaaagctttctacaatctttacataccccattaagtatgaatacttatacattctcctgcagaaatatgtataatcataatatactgccccaaatccctcttaggagaactgatagatggtgtgtggattgtctcctgtctctaaaaaacactctgaggccaggtgcgggggctcacgcctgtaatcccagcactttgggaggccaaggagggcggatcacgaggtcaagagatggagaccagcctggccaacatggtgaaaccctgtctccactaaaaatacaaaagttagctgggcgtggtgacacacacctgtagtcccacctactcaagtgaggcaggagaatcacttgaacctgggaggcagaggttgcagtgagctgagattgcaccactgcactccagcctgagcaatacagcaagactccgtctcaaacaaaacaaaacagaaaaacactgtgaattctaaatatctgacctcaggggttttggaaaaggcattttggtcctttgcaatttatacaccaacaaataatgaattaatatagtaacataataatttatttagtataccctttaaatttaatacttgcattttccagatatcaatataaagaaattggcaaacctcaaataaaattcaattggcgtgttttagagacagttatgctgctcttgtgggccgctgcctgaaatccaggtggctgcctgctggtagtctggagtgtagtgtctccagaatgtaaagcactgaacaaagcaaggacatcatgagacatcctgtttgaatattttgtctgcaatttagtgaactgtgtgatcctcagcaaattaccaggtgactctgtaacactgtgataacagtttatgtgtccaggttattgtgactattgaataagatgatgtgggtctttacacctggcctcttcatgggcatgtcgtaaattgtagcaattattaagctagataattatacatagggataatacttttctatcaaagcaaataataggcactagctaaatgtctccatgaaagctaagtatgataaaatacacaggaagcatctccaacatgaaaagtacccttagtgctttgtaagataacagttcccacagtcatagagcttaccttttggaaaggcggaagttgaaaaatgacttttttttttttttcagacgaagcttcgctcttgtcccccagactggagtgtgattttgcaatctcagctcactgcaacctccgcctcctgggttcgagcgattctcttgcctcagcctcccgagtagctgagattacaggcacctgccaccacgcctggctaatttttttgtatttttagtagagatggggtttcaccatgttagccaggctggtctcgaactcctgacctcgtggtctgcctgcctcggcctctcaaagtgctgggattacaggcgtgagccactgtgcccggccgagaaatgattttattatgtagctttgaaatgagttcaaacacgtaatttgctacatgagtgacttaacgttttcctgtgataaaaacatggagtgtaatcttccccacgagaatgctgggtcacactttatcaggccacatatgtgttgctggcttcaacctctagaccccaaacacagaaaatgtgagattttgacaggcacattgagagttcaggctgtggcaagaatactgtctgccaaccttcaggcaagtctctgaagccgtacccaccaacactggcaccactggctggcatcaggggccttgtgtcatggtggatctatgctgcattgctgaaattcactctccaaagaacctctcctagaaagggacacctcctagaaagagacacctcacacttgcattcaactgtacggctacagaggccttctgccatcctaactgaccaactagactttaataaaattagaactcacttactctgtggttaatggacctccctcctccatggagtggattccctgtgagagctgttctcattattctcccccttttgagcactgaaataaacaacaacaaaagctacaaaaaaaaacctctttacatggcaataaactgtgattcatgaaattatactttgttcatctcatttcaatcataaaaaacactttaaaaagcaagtttagccgggcgcagtggctcacacctgtaatcccagcactgcactttgggaggccgaagcaggtggatcacctgaggtcaagagttcgagaccagcctgagcaaggcggtgaaacactgtctctactaaaactacaaacttagctgggcatggtggcgggtgcctgtaatcccagctacacgggaagctgaggcagcagactcgcttgaacccgggaggcagaggttgcagtcagcagagattgtaccattgcactgcagcccgggtgacaagagtgaaactccatctcaaaacaaacaaacaaacaaacaaataaataaaaaataaaacgcaagtttaaatgaatatgagaagatggtaagtgctatgcagagaaaaagaaaaagcagaactggcttggaataggtgttgagggagcgggcagcatgagtgacaaaggtgacaggtggtaaatataggcctcaatacaaaagtgaagtcggatctgagactggaaggaagtgaggacctagtgagtatcagtagaaagtgttccaggcaaggactgtccagggcaaaggccctaaggcaagaattgccggctatgttgattcaccatcaaaagcatgcccagagccctgagccaggtgggggaattgggggagatagtagagtagatgggttcagagacctgggagtgtggagatccagagaaccacacaagacagtaccggcacttctgacagtttctttgttatgtacctgtgcttccatttgaaatcgtccggcccaggggtcagcaaactttttctataaagggccagatcatgagtatttttttttttttgagacggagttttgctcttgttgcccaggctggagtgcaatgacgggatctcggctcaccgcaacctccaactcccggattcaagccattctcctgcctcagcctctggaatagctgggattacaggcatgcgccaccatgcctggctaattttgtatttttagtagagacaggatttattcatgttggtctggctggtctcgaactcaggacctcaggtgatccacctgcctcggcctcccaaagtgctgggattacaggcatgagccactgcgctcggcgatcatgagtatttttaaacgttatggttcatatgatctctgttgcagctactgaactcagctactatagtgtgaaagccataggcagttatgtaagtgaatgagcatgattctgtttcaggaaaactttatttacaaaaacaggcacggggccatgctttatctgccagccatagtttaccgacccctgctttggcctaacttataaacacaaggaatttttctctctgttttcttctagacattttataatcgtatttattccttttttatatatgaagagatttattctgagccaaaacatgagtggccagttgcccatgtcacagccctcgggagatcctaaggacatgggcccctattttttcatttgggtctgtggttcattttgaggttatttgtgtgagtgttagctaatgcttgagtttatatagaaaatatgtcttatttatatttaacatatttctggcctatggatatctaattgttcagcactatttgttgaatgattatgttttccctttaccttgacacttcagtcaaaaatcaattgagtggggcacagtggctcacatctgtaatcccagcactttgagagaccaaggcagacggatcacttgaggtcaggagttcgagaccggcctggtcaacatggtgaaaccctgtctctactaaaaatacaaaaactagccaggcgtggtggcacgcacctgtagtcctagctgctcaggaggctgaggcaggagaatcgcttgaatctgggaagcagaggttccactgaggttgcaggttgcactccagcctgggcgacagagtctccaaaaaacaaaaaagtcaactaaacgtgtgcacctgtgtgtgtgcgcacctgtgtgtttgcgcacctgtgtgtgtgtgcctgtgtgtgtgtgtgcgcacctgtgtgtgtgcctgtgtgcgcgcctgtgtgtgtgcctgtgtgtgtgcctgtgtgtgcgcctgcatgtgtgtgcacctgtgtgtgtgcctgtgtgtgtgcacctgtgtgtgcatgcctgtgtgtacgtgtgcacctgtatgtgtgtgcctgtgtgtacccgcctgtgtgcgtgtgcacctatgtgtgtgcgcctgtgtgtgtgcgcacctgtgtatgtgtgcctgtgtgtgcacctgtgtatgtgcccgtgtgtgcctgtgtgtgtacacctttgtgtgtgcctctgtgtgtgtttacgtgtgtgcgcctgtgtgtgtgcatgtctgtgcctgtgtgtgcctgtgtgtgtgcctgtgtgtgtgtgcgcctttgtgtgtgcctctatgtgtgtttacgtgtgtgtgtgcctgtgtgtgcgcctgtgtgtgtgcgcctttgtgtgtgcctctgtgtgtgtttacgtgtgtgtgtgcgcctgtgtgtgtgtgcatgtgtgtgtatttgtctctctattttggactctctattttgctctattgatttctatgttgattcttacacaaatacaacactgtcttgattactgtatctttatggtaagtctttttttttttcggagtctcacactgtcgcctgggctggagtgcaatggcacgatctcggctcaccgcaacctccgtctcccaggttcaagcgattctcctgcctcagccacccaagtagctgggattacaggcgcccaccaccacgcccagctaattttttgtatttttactggagatgggatttcactatgttggccaggctggtctcaaactcctgaccgcgtgatccacctgcctcggcctcccaaagtactgggattaaaggcatgagccaccttgcccagcctatggtaaatcttgacattaggtaatctaagtcttttaactttgttcttatttaaaattgttttggctattctgtgtcccttcatttacatatatgttttaggggcagcttaccaatttctacaaaaaaacactgttgggatattgatgtggattatattgaatctatagatcaatttgagaagggtttagttcttaacaaggatctattagataggataacaaatgtacaaaccataaaagaaaaaaatgatgaattgcacttcaccataattaaaaaggcacaactccaaaatggcaaaccataatctggaagaaaatatatgcaaaacataaatctaataaaggacttgtatccaaaatacataaagcgcttttataactcaataataaaaaaaatcaacctaattaaaaactgggcaaaggatttgaatagacaattcacaaatgaatatatataaatggcaaacaagtacatataaaagcatactcaacatcattagttattgggaaaatgcaaattaaaattacagcgagataccactacgtagccactacaatggctgaattttaagcggctgacaatgccaagctttgtcaagagtatgagacaactggaactctcacaaattgctagagggaatgcaaaatgaaaagtatgcagtttcttaaaaagtttaccctctcctcctgtatggcccagcaaacctgctgctaggtactcaaccaactgaaatgaaaacatgttcacacaaagacatgccctgtgatgttcattgcagctttattccaaattgccaagaactggaaacaacccaaatgtccatcagctggcgaatggataaacacattaccctatgtacatacaatgcaatactcctgagccctcaaaaggaataattcactactacatataacaacctaaacaaatctcacatgcatttgctaagtgaatgaagccatacacaaaagggcacatactatgtgattccatttaaataaaaatggattgcagaaaagcaagcctacagttagagaaagcagatcagtggctgccagagaccatgaaagtggtggttgtgacaggaggattaactaggaagggcatgaggagagttggagggagatggaagatggacctgttctacactgtgacttattgttaaatgatgcttacatgtgtggaagccgttgaatcacaataagcaggcaagctttgatggaggcttgaaccagggtgatagggaaagggaactcacaatgagtcatagacacaaatgttaaaataaaactagtaaacatctagaaaaaaaaaacgaaagaaaaggctgggtgcggtggctcatgcctgtaataccaacattttgggaggccaaggtgggcagatcacttgaggtcaggagtgcgagaccagcctggccaacatggtgaaaccccatctctactaaaaatacaaaaattagccgagcctggttgcgcacacctgtaatcccagctactcaggaggctgaggcaggagaatctcttgaacctgagaggcaggggttgcagtgagccccactgcactccagcctgggtgacaagagcgacactctgtctcaaaaaaaaaagaaaaaagaaatcagaaagaaaaaaacctttctgtttataagttaggccaaagcaggggattggcaaactacatccagcaggtgaaacgtggcctccgccctgtttttcctaaataaagttttaccgaaacactggccttgcttactcacttgcataatgcctatggctttcttgctgcaggactgagctgagcaggtgaaaagggctcagattctctgttttgaaggtagagtcacaggatctgaaggctcgggtgtagaacatgagttttgaggatgatgtgccaccctcctcgcttcctgcggaaaggacggccgtggctgagcgcggtgggtgcgggccttgatcccggactgcggtgtgttgtcaggtttctccaccgtaagatcctttttccacaccgcgctcctgggaagaaagtcagaaagtgcagcccttccttaggcaagcgggagtttcgctccggctctatccaccctgtttttaaaactgaacatcgtacacattcgaaaacaactacaaattctctttcattagctaattttattttattggttcctcttgaagttagatgatgttatacattcatgatcccagcccagagctcctgattcagcctagccagggtgaaacccaccggattaacaaatgcctcgtgtgattcagatgcaaatagcccatcagcccacttcagaaagctcctctctaatcacttactaatgataattactctgaactaggacctctttacggaggctgaagctgtttttctcttggttaaggtattgtcattagtttcctgtcagagtcggggtcacctctctgcccttgtcggcctgcccaacagtcacacaagttgaacgaattcggcaaccacctcattactattcattgcccatgcggatattcaaacgcagcacacagctctatcgcggctccactccacgaaaagtcccaagtatatacaaataattgtataaagtactaaaaatgcactttaaatgagttccacatctccaagacacagacaaaccaaggctattgtcaagagtccttctagaaatgtgccttcaaaagacacaaaaggaaacaacgggagacattcaacgaggacagtggtttcctccgacgaggggaatggaaagcctggcgctgggagagctgcgctcttgaccctcctttccctctaactcgcccagccatctagggaaatgcacttcgtttttgcgcttcaacctcttatctgtaaaacattaataataggccgggcgcgggggctcacgcctgtaatcccagcagtttgggaggccgaggcgggtggattgcctgaggtcaggagttcgagaccagtctggtcaacatggtgaaaccccgtctctactacaaatacaaaaattagccgggcatggtggtgcgcgcctgtaatcccagctactggggaggctgaggcaggagaatcgcttgaacccaggaggcggaggttgcagtgagccgagatcgcggcaccgcactccagcctgagccacagagtgaaactcagtctcaaaaaaaaataataataatagcacctgcctggttttactttgcgtagatttaggataaaattagacactgcgtgcatctgagaaatacagttgtcacacagatgtgaagttttctgttttttgtttttttctaaagcagtcttgtttcaataaaaccttatttacaacaacggattttctttatttctttacaaatactcatgggatcaaataattcaatttttaatttttaatatcatcatgattctatgcccagatctaggttaaggaaacaaagttgaagaaacaaattgcctctgatgtcccagcagataatgaagtagatcaagatatacgacacacaaaattatacacaaaacctgtagattctaggagtattcctatcaagttctatttagttgcttaaaataattaccttagcattctaaaaatctgtaaacaatatggcatttctgaatatttaacattggccttttcaaaatgaagttcaattaccatttcccctgagaagctgtaagcctgagagggtctcgtctcctgacactacggttttcaatcctggctcggccgcttactggctggtgattgtgggtgagtttctatgctcttcagttttctcatcagtaaaataaagataagaacagcaccaactttgtgggttatctgtgagtagttagtgtccacatgtgcagaagtctttagaacagtgctatatgtgtttaatattgttatttttattactatcggttttaagggattaagcagctgttgaaaccaatgagactacttttttttctttttctttttcttttctttttcttttctttttctttctttcttttttttttttttttttttttttttttgtttgagacggagtttcgctcttgttgcccaggctggagtgcaatggcgcgatctcagctcaccgcaacctccgcctcccgggttcaagccattctcctgcctcagcctcccgagtagctgggattacaggcgtgcaccaccaagcccggctaattttgtatttttaggagagacggggtgtctccacgttgaagctggtctcgaactcctgacctcaggtgatccgcccacctcggcctcccaaagtgctgggattacaggtgtgagccaccgcgcccggcaagactactctttaatacacgcacacacacacaaacacaaaacctggaaaaatgtgctcaaatagtttgttagtactttatataacaactgaaaattctttggatttaatcaaaatggcatatttgaagtaaaaacacctatacctactctctcaagcctcttaggtagaaaatatttgatagaaaggaaattaattggattaccaaaggacagtaggtgaccccaattacttttgcttttaattataaaaaaagtctgagccataaaattggaaaactcttcctgtaatgaaaaatgtagagaagtagtttcacaattttacattttcttttttttttttttcttttgagatggaatctcacgctgtagcccagactggagtgcattggggcgatcttggctcactacaaactccaactcctggagttcaagcgattttcctgcctcagcctcccaaatagctgggactacaggcacctgccaccatgcccggctgattttttacttatttatttatttatttttatttttaatagaggtggggtttcaacatgttggccaggctggtctcaaactcctgacctcaggtaatctgcccgcctcagccttcctaagtgctgggactacaggagtgagccattgcgcccagcacaattttttttttttttagactgagtctcactctgtcgtccaggctggagtgcagtggcaagatcgtggctcattgcagcctgcatctcccgggttcaagcgattctcctgcctcagtctcccgagcagctgggattacaggcacgcaccaccatgcccggctttttgtgtttttagtagagatggggtttcaccatgttggccaggctggtctcaaactcctgacctcagatgatccacccgcctcggcctcccaaagtggttggattatcggtgtgagccaccgagtctggcacaattttacattttctctttaactgacacaaaaggtcttcctcttatgtgacagtatattacgatggtatgatataccatcctattgactaatatttaaaattgcaaatcacttatcgaaatccagatttttaaagattaggtttaaatctgaatgcttcacaaagatcacttggctgccccggaagagctgagttccccccgcgctcagaggccgaagaggtctttgcgattatgggagctttcttaccactgtgggcacagagtctcatggcacctacacaaagggcctgctcctgtatttttttgtggtttcccattccattcagcacagacaaagggacccgttgaaaggcacacaggtggattctcttaaaagacatttacggatattaaaattttaaagtttatctgagcaaaaagctattcataaattgggcagctccagacggcaagcagttgggctccaccaaggaggggagtcgaggggactacttttataagatgtttgtagaaagaggctggttaagcttaatttactattcacactgagcactgtttccgtttgctgacagaggaactcaagggattggggccagctcaacctaatggtctctcaattgattttttttttttttttttgagacggattctcgctctgtcgcccaggctggagtgcagtggcgcgatcttggctcactttccaggttttcttattgccctttttctttatttcggcaagagtgagggacatgcagccaacagtctccagtaattcttcactctggcttccttcagtagggacttgacattttgatgtaggtgtcttgatgctgttgtttttacatgtacattttccctcggaccaaaaaacaaacattaaatatttcctcaaaaaaaaaaagctttatttttccctgcttataaaaataaacagaggccaggtgcggtggctcatgcctgtaatcccaacactttgggaggccaaggctctgggaggatcacctggggtcaggagtttgcgaccagcctggccaacatggtgaaaccccatctctactaaaaatacaaaaattagccaggtgtggtggctcgcacctgtaatgccagctactggggaggctgaggtaggagggtcacttgaaccctggaggcggaggttgcagtgaaccgaaattgtgccactgttctctagcctgggtgacaagagcgaaactccatctgaaaaaaacaaaaacaaaaaaacccagaaatctctcaattaaaaatggatcctgaatttcatcttttaattttatatgtattctgaaatgctatcagaaacaactatgaataatggagatgagagatttcaaagaatttttacaaagaaggcaataatgatctagagcttgactctagctctgtgtaaaataaagcttgataagtagttgttatcggccgggcacggtggctcatgcctgtaatcccagcactttcggaggccacggctggcggatcatctgaggtcaagagttcaaggccggcctggccaacatggcgaaaacccatctctataaaaatacaaaaattagccgggtgtggtggcaggcacctgtaatcccaggtactcgggaggctgaggcaagagaatcgcttgaacccgggaggcagaggttgcagtgagccaagattgcgccattgcactccagcctgggcgacagagctagattctgtctcaaaaaaaaaaaaaagaattcattatctccaacatgtttactatagctggggagcaaagtgaacataaattgagtataaaaggtaattcataatgaagagctaaattgtgttgtgaagactgaggatgttacagttcaaagcactgagggctagagcagcaaagacggcttcgtttgtagtgaagtgccttcaaccactcctcaccccagttgcctgcttcgtaggcatacctcttcaggaaaatcactaatttatactctccaagaatacatgagtgtgctacaaagaaaaaaaattaatggtaaaaatatttatagaaaaaatcgtttgaagtgaattattatacattttttagatgtgatgatggcattgtgatcatgtttccgaattttccttatctattagataaataaaatagttcttcatgatatgaaatgtcgaaaattttcttcaaaatactccaaaaataagtttcctggcacaacttttaactttgccaagcgcaatgactcatgcctgtaatctcagcactttgggaggccgaggcgggccaattacttgagcccagaagtttgagatgagcctgggcaacatagtgagagactgtttttacaaaagtaaaaaatatatttaaaaaaataaaatactaggtggatgtggtggcgcatgcctgtagtctcagctactcaggaggcgaaggtgggaagattgcttgagcccagaaggtcgaggctgcaataagccctccagcctgggtgacacagcaagaccctgtctcaaaaaaaaaaaaaaaaaaaaaaaagaaaaaaaaaaaaagaaaaaaagtaaaaagaaaagataagcttaacaaaaaagaaaagaaacttttaacctttaggttgattaaatttctacgagattttctgatttttctcatgggctaatagtcatgagaggttagaggtttatgataagaattttttttttttttgagactgagtctcactctgtagccaggctggagtgcagtggcgtgatctcagctcactgcaacctccgcctcccaggttcaagcgattctcctacctcagcctcctgagtagctgggactacaggcacccaccaccacgcccggctaaatttttgtatttttagtagagatgggtttttgccatgttggccaggctggtctcaaactcctgacctcaggtgatctgctcgcgttggcctcccaaagtgctgggattaatactatcaaattgcctttttgttttgctaatatttaatactcatgataaaaagattttagactgtagcaggtttttctttttaaccctggttatattatttggcatgattcagatgttgaagtagcctcaattttaaaattctgccaggcgtgaaaaggcatccgccctctagcttactttacctggccactgcttgtatagcttacgaggtttaatcttgtcatttctggttgagagaagcagattttcacccacatgtagggttttagctatgtttgttttttctaaacagagccaactgttaattaatttctaagagtaggtaatacatgcatgcacccattacaaaagtagaaaaacaaaatgatttacaatgcaaagcaaatctccctctcataccaagcccccagctacccaggctccagcctgctcacttaactttggtcaattgagatcagtttacactccttcattgtttcataacctcttggaaagttctcgtaacaggaaaatgtggctgcattttcaattctgacctgtttctctaaatagatcacattctctaatctttctatgacttttctttctttcttttttttttttgagacagagtctcgctctgttgccaggctggagagcagtgacacgatctcagttcactgcaacctccgcctcctgggttcaagcgactctcctgcctcagcctcatgagtcactgggattacaggcacgtgccaccatgcccggctaattttttgtatttttagtagagacagggtttcaccatgttggccaggatggtcttgatcgctggacctcctgatttgcccacctcagcctcccaaagtgctgggattacaggcgtgagccaccgcatccagccaacttttcttaatttaagatggacttctatctcactgtgtaagtaaagctcaaggcatcatttattcttttaatattcacttcctctcacttctacaggatgtaaactgtctcaactctttttcttcgtttgtaagctgtgatcgtttcttaatttgttttattatttttattgccttctctgttttcctaaaatagtttctaaattttaaatgaacttttaattttagaaaagttttagatttacagcaaagatgaaaagataacacaccctcactcccaatttcctgcattgttaacgttgtacattatgatggtatatttgttacaactcaagaccaacactgacgtattattattgactaaaccccacactttatttcattttactagtcttcccttctatcctttttctgttccaggaggccatcaggatcccacattacatttagatatgtgtctccttacattcctctagtttatgacaatttctcagacttcccattttgataaccctggcagtttcaggagtactggccaggcccctatacaaagttcttccatcttggtttgatgtttttatgaatagactgaggttatgggtgattggggagaatatcacaacactgaagtagcattctttttttttttttttgagacggagtctcgctctgtcgccaggctggagtgcaatggcgccacctcagctcactgtaacctccacctcctgggttcaagtgattctcctgcctcagcctctggagtagctgtggaccaccacgcccagctagtttttgtatttttagtagagatggggtatcactatgttggccaggctggtctcgaactcctgaccttgtgatccgcctgcctcggcctcccaaagtgctgggattacaggcatgagccaccgcgcccggcctgaatatgatatgattcttaccatatcatatccgggtgcatgccatcaacctgactcttccctgatgcaattaacaccttgactgcctggctgaggactgcttgtcaggcttccccctgaaaaattaccactcctccacctcttttccatagtcttgaaacaagctgctggcatcacctacacttagggtagagaggaattcagctccacctcatcgaggggggaaatatttacatacattatttggaattccctatgggagatttgtctcttcttcactattcatatgctagattttctgtgtattacagggttctttttatacagcaattaccaaaaaaaaaaaaaaaaaaaaaaacctgcctactgcctacatataaacatttttatctgagatatttccattatacctctaaatgaagaaagtaaatgctaacagttgttaactgataatttgttcaacaaatatgcattaggtttggcgagatggtttatgtctgtaaccccagcactttgggaggcttaggtgggaggactgcttgagctcaggagtctgagaccagtctgggcaacatagaaagatccctgtctctacagagaaatttgtaggctgggcgccgtggtttacgcctgtaatcccagcactttgggaggtcgaggcaggcggatcacttgaggtcaggaatttgagaccagcctggccaacatggcgaaaccccgtctctatttaaaaaaaaaaaaaaagtagaaaaattagctgggcgtggtggcgggctcctgtaatcccagctactcgagaggctgagacaggagaatcacttgaactcgggaggcagaggtttcagtgagccaagatcgtgccactgcactccagcctgggtgacaagagcgagactccttctcaaaacaaaacaaacaaacaaacaaacaaacaaaaaagaaggaaatttgtaaaaaaaaaaaaaaattagccaggcgtggtgtcatgcacctgtagtcctagctaccaagggggctgaggcagggggatcacttaagcccaggaattcaaatctacagtgagtcactatcctgctactgcactccagcctgggtgacagaacaagaccccacctctatacatgctaccctggcaggcacttgataaacacagtgctgctgatgaggctcacgggctaatagacaatcacaatgcggtatgattggtgacctctggaatatatgtatacatgcaaaggagcctacaggacttccacacagagggcttagggtcagcaaacatctcagaaggacgggcattcggctgggcgcggtggctcacccttgtaatcccagcacttcgggaggccgaggcgggtggaacactaggtcaggagttagagaccagcctggccgacacaatgaaactccgtctctaccaaaaatacaaaaaattagcctggggtggtggcgggcgcctgtaatcccagctactggggaggctgaggcaggacaatcgcttgaacccgggaggcagaggttgtggtgagctgagattgcgccactgcactccagcctgggcgacaagagccaaactccatctcataaaaaaaagggacaggcatggggcatgccaggcaggcaattttagactgtacttgtgtagatctttacttgacgttgcagaaatgtcaactgtttatatatgtatttttaatggtagtgtatgtgatacagaagtgctgggtagagaagagcatggtccctttaaataattcggaagtggggaagggatgtgccgggtaaaggagggcgtggtccttagctagggctccgcccccacggacctaggtgaggacaggcatctctgcccaaatgttgcatttcccgcccaaatgttgcatttcccaaaaccaccctggcctgccatggccgcatcctgggcctataaaaacccaagatgctagcaaggcagtgacagaggccgccagacgttgagaggacaagtcagcagaagacgccacagccgctggcggtggagaggaggtcgagaggctcacgcgcgcagaagaaaataccggcacacggacaggccattgaccggcaggaccaggcggagtttggcccgggcagtgggaggagagccaggggaagatcatcttccttctggctccccatcgtgggagagttaacacttgacactcgttctccaagcccaggtgtgctgcgattcttcaggtacaccaaggcaagaacccgggatacagaaatccctctctccttgcgataaggaagggggcctattgagctggttaacatgagccgcctatagacaccttgtaacagacgccccctgggtcttcaggagccgtaaacatccaccgcagacaccgccgtggggtcggagccgcacaaagctcccctggaggtttgagcagcgggaagcgagccagagccacaccccaactgcacaccctgcgggggcctttcagatgggaagagagtaagtctcctcctggtactgtaactttgaggtttggtgattttttttttttttaaacagtctttgaagactgatataaatggtttggccagtgccactaccaggtgctgtctggttttagatgaataactttaattccctgagcttaacttttcatattttcttagtgttttgtgaatattcaagctaagtcagcagtagcgacttagtgcatgactttttgccacccctaatgcatgtccctttgcaatgtgatggttatcttctcccatcaataggtgaagtccattttctcctcctttgagtctgggcttgactgactaacacggcttttgctaatgggaaattaacaaacatgataaagaggcttaagaagaactgacgttggggttttgcttcctgctgctcctgggaccctgctgtcatgtgaacacatcggattatcttgtcggagaatgagaccaggggaagagaaccaacctaccctggccgatagaaagccactcccagggccggacacggtggctcacgcctgtaatcccagcactttgagaggccaaggttggtggatcacttgaggccaggagttcgagaccagcctggccaacatgatgaaagcccgtgtctactaaaaacacaaaaattagctgggcgtggcgggcgcctgtgatctcagctactccggaggctgaggcaggagaagtgcatgaacccgggaggtggagtttgcagtcagccaagattatgtgctccccagcctgggcaacagaatgagactgcgtctcaaaaaaaaaaaaaaaaaagcaaagaaaaaaaagaaagccactcccagagggtaagtggggccatctggatatactagccctcaccagtccactgactgatcaccagaatttgcaaatgaagacaaatgcatgagtgagcctcaccaaaaatagcaagcaaagtgtcctgcctcgctccagtgatgatctatagaatcatgagttgacaattgttgtgttaggacactaaggtttggaatggttcatgacacagcagtagattaccaataccagtcaaatggtgatgagaacagagtaactgttgcaagtttcagaagtaatgctgtgtttttgtttttctttgagaggtttgagtgctgtgctcacctaagtttaaaatgaaaatggggctgggcatggtggctcacgcctttaatcccagcactttgggaggccaaggcacgcggatcactagaagctaggagttcaagacctgcctggccaacatagtgaaacctcgttctctactaaaaatacaaaagttggcggggagtggtgactcatgcctgtaatcccagcacttggggaggccgaggcgggcagatcacgaggttaggagttggagaccagcctggccaacacagtgaaaccccgtctccactaaaaatacaaaaattagctgagcttggtggtatgcgcctgcaaccccagctactcggaaggctgaggcaggaggatcgcttgaactcgggaggcggaggttgcagtgagccgagattgtgccacagcgctccagcctgggcaaaagagctagactccgtctcaagaaaaaaaaaaaaaaaagttagccaggcatggtggcacacacccataatcccagctactccagaggctgaggcacgggaatcacttgaatctgggggcggagcttgcaatgagccaagagcgtgccactgcactacagcctgggcaacagagtgagattctgtctaaaaactaactaactaaataaataaataaatgagaatggtatttgcatatagccactagctggtccccaaaagcctcttccctggccaactggtctcctgcagaaccctgactagtgacaattcctccatggaacctctttttctattattaaacaattatataagtgcatattctgggtaggaagtgctttcacactctaaaaaccctcttctgtgatgaaatctggttgttttcctttaaagatgaaatatatttctactgaccccaatgtggagatcaagtgattctcaccttgaaagtatcatggttggtcactgtgattagaacaagaaaatgctgtgatttttctctgcaacagtagggccgacttgtcctgaaagccgaaagtctttgcagcgaaaggaaagggtgcagtggatgactcctagccctgagaataacatggatctggaaggtccatatatcattcagtgaatcagtaaacaccactgggttccctttggggatatagcaccaacaataaagggccctgttctgaattctctggaattaaactgagtgttcaggatgcaaaactcattaaaaattggcagttgcggcatggcatggcataataataaatccaggagcagaagggatgcgaacccatatatcaaatgaggtcccaaacgctccccagtgtgtgactcctgctagttctagtgtggctgccattgcatgggacgtgttggagtccttcatgggcgctccatgaaagacatctttctgtgctacaggcagccctggtgggatgtgctcccaccacaatgaaaaagtcagccctagaaagatcagtggcagaggaaagaagtgggtattttgctttgtttttttcccaaaacagaaagacgtaattgctattcccactctggtaagcttggcatataaataccagggactctggtcttcctggcaacccctctctccattggtactcagtcactccaagcatgttccatggcatgttaataagtgctgcttcaacaagccttaaagaacatagttccactcttcatgctaattgcctatgcacattctctcccacctttcaccatcacaaattcagaaacagccagcaactcctcacaagtgaatggtattaagctgttaggtcgtaagtaagaccaattgaatcaacaggttcataggactttaaacgtcacactgcttcagatgtctagatcatcagttactcccatcctgctgtgcctccatctccaggtttcttcacatgagcttactagcttaaatgagatttatttgaactaaaaaggtgaaggatgacagggcatggtggctcacgcctgtaatcccagcactttgggggccgaagtgggcggatcacctgaggtcaggagttcgggacctgcctgaccaaagtggagaaatcccgtctaccaaaaatacaaaaaaatgagccgggcgtggtggcgcatgcctataattccagctactcgggaggctgaggcaggagtatcgcttgaacccaggaggcagaggttgtggtgagccaagatcacaccactgcactgcagcctgggcaacaagagtgaaactctgtctcagaaaaaataaaaaaaagcagaaggatctccccacgctctcacaatggttagttactggttaaaattcattatgtgcctttagaaattaaagtgataagttggagacctaactagctctgaaagctaataagctacggcagagagggtgggaatctgagaggcagagagtaagagtaagtaaaggagagtaagagtaagaaaacacgtgtggggtccactctaccctgtgacggtgtcaataaactgtatgcaaaaggctagtactttttttctgaacttgtctaaatctacttttatttaaatagaaatccaaaacacttcctaggttatgattttcaagatcagtctaaaatttaaaagtaagcccctaaaaataatgtttgaattattagctatagaaaatatttcatggctgggcatatgtgtctcacgcctgtagtcccagcactttgggcggccaaagcgggcagatcacctgaggtgaggaagtcaagaccagcctggccaacatggtgaaaccctatcttactgaaaatacaaaaattatccgggcgtggtggcgtgcacctgtagtcccagctactcgggaggctgaggcaggagaatggcgtgaacccgggaggtggaggttgcagtgagccaagatggtgccactgcaatccagcctgggagacagagtaagactccatctccagaaaaaaaaagaaaatatttcatgcctatcaatcagaaaaaatacaataattattcaagcacacatgaaatcttaaaatcatgttcacgtgctagcatacgaggaaaaccttaatccattctgaagatcaatattataaagattgtggtctgctgataatacagtaaatttgaaaccattagtagatgattgatttaaaatgttatgcccgggacatttacaacatgcaattaaaaacttctgagcaagcttttgccagtgcctgctgccttttgtgattgtgcatcctagctgaggcatgcagaaccaaatgaaagcaaggattcattaactctttgaacttgttaaatgctaacagttaaccattagaaatggttcaacgatgtgagccacactacttcaactttttctttgttgtagttttagaatggtcaatttttagctacttgacagattaaaagcaaaataatcacgccatatttagtcctggagttcaagtctacatgtttatgtgaaaaatctttgtaataaacttttaacatgagaaggcaaccttaagctctattttagccaaatgaaacaaaacctgaaattgtattagaacatttccctgtcttcaaactggtgtaacagaatcctgatatgcagcttgatggatttcaccagttaaggcacattcttctccctccgtccctgcaatactgtgtatactgaacaatgtgcatttgtctgaggagttattttgtttgccaccacttaacgaatctcaaaattttgagtaactgtacctcagtctaatcggactttttatgagctttataactacattgaaacccttaattcccatttctgggtgtttgtgagcctgattgctgtcatttgcgactctaggtactcaccagctaaataaacatagtttttgtgtggccagcacgtactgctcctcaattcctttctccagcttccgcggcgtcctggcatccttaaaatatctacaaaatatggccttcattcataaatgaaatcagtttctatgtgagtgtgtggatgtttattgatcgcacatgtataagtggaaatacagcatatgtctgggtattcttttttcttttgagacagtcttgccctgttgcccaggctggagttcagtggtgcaatcttggctcactgcagcctccaccttccaggttctagtgattctcctgcctcagcctcctgagtggctgggattacaggcgtgtgtcaccatgtacagctaatttttgtattttcggtagagacaggttttcaccatgttggccaggccgggctcaaactcctgacctcaagtgatccgcccgcctttgcctcccaaagtgctgggattacaggcttgagccaccgtgcctggcctgtgtgggtatttgtatagtcttctttttaacatatttttttttcattaattacatatcaacattaatttcgtatcttgaaacaagttgattttgtataattaaaggtgccgagcatctataaaataaataaataaataaaaattaaaatcttctgagcaaaatgaggttcattttgaagaatgtagaataaatgacagcagcaccccatgttgatattggtagaacactgccaaagcagtatctagagggaagtaaagaactttaaatatatgaatgaagaaataagaaagattggcaacaaattaggtcaggatttgacccagaattcaccctttagctgttctgagatatagttcatacaagaaaagtaggataaatcctttacttttttatttaccagactttagaataattcattgataaaatactaacaattctctgatccctaggtagagtattatgcatgagttttcacttcatttatacttttatttctgaaattttttttaccaaacatattctaactttataatcagaaaaatacttttgaaaaaggagtcagggaataaagatatatttgcaacttagtaaagttcctctgatctcttgaagtattaaaacttttgaatacatgtgaaaaaaatttctaagacaactcatgaaatctgaaactgggatggtttctggaggttttcaaagaaagcgtctcatactaaagttaagacctctgttttatgtcattttaaaagagagcgcagctctcgtgctggggcattgcttcaacccgcacttggaggaatgagcatcacttcctgaatcaccagccttttctacagagcctcgattttctctagggtcttcccatccacacaccggcaatgctgacaatactcagagcttatgaaacctgacagatcacagtttgaggtgaaaaaactttaggaatgaaaactatcaagaggaattggaaatgaaaggtgaatgccattatatttattcaatttatagctaaattataatggaaaaaatctcgaaatagaaacattttttaaatctgaagactgtaattataacaatgagcattgtcataatgttgacctgtgtcacattacaaatattctttatcaataagacattaaatgtaataagttaatgaagaagttatgacttttgccaaaatgatagggcagtttttttattttgaattttaaaaaaattgtgcttcagtttgcaggatgtttgtgtgtgtgtgtgtgtgtgtgtgtgtgtgtgtggtgtaggggggtgttggtatgagatagaaattgactaacacagtccagcttctgttgattctttttctttcaaaaaaaagtcttcccataatatcttacactgctcgtctcagtagtttagtcaatgtttaacacatgccaaaatatttctgactctcagaataatttgattttagagaagtagatgggaccagccaggttcttaattttttccccacaactttttattttgagaatgttcaaacccactgaaaagctgcagatagtccagtgaataccctttgtgatgggctaaattgtgtccctacaaaattcgtatgttgcagtcctaaactgcgtatctcagaatgcggctgtgtttggagagaggatcttaaaagacgtgatgaagttaaggccattagggtgggccttaatccaatctgactgctgtctttgtaagaagaggaaattgggacacaccctgggacacccctgtgaagcagctgcaagagccaaggagaggggcctcagaggagaggaaggaccccgccgacagcctcagcttgggcttccagccttcaggactccgagaaaatggatctatgctggttaagccagccagtaagtggtattttattatgcgagcctgagcgaactaatataccttatacctttcttatacgttcactaattgttaacattgtgtcacatttttgtgatccctctctctgtctccacaaacacacatgcataggcatgcacacacactaacatgtgaagtatacacatacaacctatcacacacatcatacatatgcatacatatgtgtgtacatatgtatacgcatgtctaccacacttttggcaggggtgaaggaacaggtgaaccattacatgcctgttagttgcaggcaacatgacttttttttcctaaatacttttgtggaaacctcccaagagccagtacatttgcttataaaaccacactataagtttcatattcaggaactaaaaacagtactacattatacggtaatatgcggtcatatttaaatgttcccatttgtcctaatatagttaggtttgtttgtttgtttttctccaactcgaagtttaatcaaggcacacacactgcatttagctgccaagtgtgtttgcttttttttttttttagatggagtctcgctctgtcacccaggctggagtgcagtggtgcaatctcagctcaccgcagccttggcctcctgagatcaagtgatcttcccacctcagtctcctgagtagctatgagtataggcacgtgtcactgtgcccagctaattttttttttttttttgtagagacagggtctcactatgctgcccaggctggtcttgaattcctggcctcaagccatccttccacctcggcctccccaaaatgctgagattacaggcatgaaccaccttgcccagcctttattaagattttctattggtgcaaaagtaattgcagtttttgcaatttttttttttttttttttgagacggagtctcgctctgtccccaggctggagtgcagtggtgcgatctcagctcaccgcaaccttcctctccctggttcaagccattctgctgcctcagtctcccgagtagccgggattacaggcatgcaccaccacactcagctaattttttattttctgtagagatggggtttcaccacattggccaatatggtctcaatctcctgacctcgtgatctgcccacctgggcctcccaaagtgctgacattacaggcgtgagccacctcacccagccgcaattatttttaatgacaaaaaccgcaattccttttgcatcaacctaataatacattcttgtcattattcggatggtcaaatattcccagatttacaagcaggtgtgcttttaagctggtttgcctagcctgtgacatgtccctatgggttttcagcacatccttgcttaagccgataaacaatgaatagcaagtttttcattttgttctatctcttattttgaatctaaaagagcagcccctttttgtttcaaaatcttattgacatattgaagagattggtccggtttctataatgttctaccttctagatttgtccaagtgtttcctcatgatgtcatttagctttgcttatcacgtgtattttgtataatgtgaaagtgagagctaaaggtttcattagctgccaggtaagtagttttggccagatgttttataagttgtgctatactttatgattgcatcacattagcatgtaatatttagttgtcctactcttaaatttaatacttaccctaccattattgaacaaaatacacaaagcaacattaaaaaaagaaaaacaaaaatttaatacttaccctactattaaattgagctgtaatttcatcaccagtgtgtataataaaatgtcaccacattcacaaaactcatgtttttaattcaaatgagatattattgcctaatgactgtaagtgagactttagtgatttcagcaaatatatataatcgttttttgagaacacatccttaaatttcagaaaattgcagtaaaaatgaagtaccaacccattcttggtattacattctaaaactttggcatttttcctttgatcaccaattccacatctggagatactctccggacacttgtcaagttcatgattttactacaggagtctattcgagcaatatttgtaggcacaaaaatgcagaaacagtttcttcaagaaggggcttaataaacctaatgtggaacattggttatgtaactatcatgcagtcactaaagacgaggatctctgtataaggagacagactactatgcagaaattatttagtgaagaaggcaggttgcagaaccctgtatctagtgcaattccatgtatgtttgaaaagagcacagctgaacggaggaatgaatgaagaacatgtggaaacatacacaaaaattagaaaatgttagagaataactttgataaagttagataagattttcgttgtaaaaagcacctattttgaataaagattcattcaggttaaggcctcctttggaccccttacattcacgtggattacttttcaagatatattgcatgatgtctgtatgtctgacattcttcaatatttcaagaaaaagggttttgcaaaaaggccaatctatctaaccacaaatatgacttctaaattaaagacttaccaaaggctgggcgaggtggctcacgtctgtaatgccagcactttgagaggccaaggcaggtggatcacttggggtcaggaatttgagaccagtctggccaacatggtgaaaccccgtctctacggaaaaatacaaaaattagccgaatgtggtagcgggtgcctgtaatcccagctacttgggaggctgaggcaggaggatcacttgaacccaggagacgaaggttgcagtaagccaagattgtgccattgcactccagcctgagcaacagagcaaaactcagtcaaaacaaacaaacaacaaaaaaaaagaaaaaaaagaaaagaaagacaatcaccaaagatacctaattttggcctggcatggtggctcatgcctgtaatcccagcactttgggaggccaaggtgggcggatcacctgaagtcagaagttcaagactagcctggccaacatggtgaaaacccatctctaccaaaaatacaaagattagctggacgtggtgtcacgcgcctgtagtcccagctacttgggaggctgaggcaggagaattgcttgaacccaggaggtggaggttgcagtgagccaagattgcaccactgcactccaaccagggcaatagagtgagactgagtctcattaaaaaaaaataaaaaagatacccaatcttgttacagaaataccaaagtgcagaaatcagaaaactgcatagatcacaaaacttggataccacagaaacagtaatcacaacaataacaacaaaacaaatggaaggaagccaaaccttacaacaaaatgaaccgcacttccttagaggaatgatttgtgttaaataaccaccatcattcacaaaaataacaatcataaattagtagcacatcactgtctgaaggttctcatttttcaaaaagcacctggagcgagcatctctcgcatatactttttgcaggttaattctattttggagacttcttagcttaagatgagccctaagtggacagctgtttagtttcagaacagtctcccccatgtgtatgtgctggtgagtgacacgctccacctgcctgcaggagctgctgcctccttacatctcccagccatgcatcgcgcctttccctttgggaagcacttaatgagccataggctcctgaaagtggaaagagaacacgaaagggcctctggtcctgctgacaaagtcatttccgctgcgcctggtgctttttggttttcacattggattcacttcacttttaattaaagaaacgagatttgtgtgtttctttttgattttggtcatcttccccaaattaaggctctgtctctcaaacaggaagttaacatttattcaagtcaggaacataggggctagcttttccttttccacagatgtacctgagatatttggccaaacttgtccctacattcaaagatctctggtgggattacatagcctaaacgaactcaactactaagttatctttggctatcttcagatatgacccactgatatggtttggctctgtgtccccacccaaacctcagcttgaattttactccccataatccccacatggtgagggtgggacctggtgggaggtatttgaatcatgggcagtttcccccatgctgttctcatgatagtgagtgagttctcatgagatctgatggttttataagcgtctgtcatttcctctgcttgcattcattctctctcctgccgccctgtaaagaggtgccttctgccatgattgtaagtttcctgaggcttccccagccatgtggaactgtgagtcaattaaaactctttttttatagttacccagtctcaggtatttcttcattgcagcatgagaatggacaaatacacccacatagctatcttctttattcatggatataattcttacagttagcaatagacaaaattggacccttttttagtgttacactagctcaattgcatagacatccagtgacctacagctttcctaagactctaatgtttaaagcactgtcatgccccgggccctctctcggcactgccccaaggaagtttgactttgcctctctgtggctcagatttccgtagacagttggaaaggcacccaacaaacaccccatccatccatattcatgcaacttctttatggtttaatttaatagagtttgcctccccactgaatccaattttaacacaaaaacaaataaatttctacttcaacgaaaaggaggagaagatgcctatactttgcttatctctgtgggctattccattgtatcttaacctaaggaaagtggtcttttggggaatacatagaaattataatggagcaattaggcagctcaatgaaacaaaaagacatttaattcaatcaattgaataaggagaacaatcacattcaatatggtactagtgtatcatgtgtggaatatttgtgcatttccaaatctcttgatacaccacaaaacacactcaagtttcatggccttagttaactgatctgcaaaaaaataaacatccctcagtcattcctacatgacctcataataacccatatttctacttttctttcctgctgccttttcttgtagctcactacttaaacttctaggccgggtgcggtggctcacgcctgtaatcctagcactttgggaggatgaggcggaaagattgcctgagctcagaagttcaagactagcctgggcaacacagtgaaaccctatctctactaaaatacagaaaaaaattagccaggtgtggcggcatgtgcctgtagtcccagctacttggaaggctgaggcaggagaattgctgaacccgggaagtggaggttgcagtgagccgagattgcgccactacactccagcctaggcgaaagcgagactctctcaaaaacaaaaacaaaaacaaaaacaaaaaaaacttctaacaaaatgccttccagcctcagaacacttccaaagtgctgtcccaactagctcctgattttccttttatctagcaccttcacctgcacaacttgaaccctttacctacattattcttcttacaaaactcattatgggctgggcgcagtggctcacgcctgtgatcccagcactttgggaggccaaggtgggcagatacccaaggtcgggagtttgagaccagcctgaccaacgtcgagaaaccccgtctctagtaaaaatacaaaattagctgggcgtggtgatgcatgcctgtaatcctagctactcaggaggctgaggcaagagaattgcctgaacccaggaggcagaggttgcagtgagccaagatcgtaccattgcactccagcctgggcaacaagagcaaaactctgtctcaaaaacaaaacaaaacaaaacaaaacaaaaactcatctcttcagaaaggccataggtttccttgcctctggattccttgtgtcccccatagtacattcattgtcccttcgatctccatggctcctcttctaggctttgccacaaatggtaagccttctttctgtgggtcttttctgcatgatcacactcacctcgtgtgtgagtaaaacacgaaaaattaaatttcaaacccagacctgtctgcttcgctctagtccttgagtcacattctcatctctctctttttttatttttatttttgttgagatggagtctctgtcgcccaggctggagtgcaatggtgcgatcatggctcactgcaacggccgactccctggttcaagcgattctcctgcctcagcctcccgagtagctgggattacaggcacgcaccaccaagcccagctaatttttgtatttttattagagatgaggtttcacagtattggccaggatggccttgatctcctgacctcgtgatccacccacctcggcctcccaaagtgctgggattacaggtgtgagccaccgcgcccggcctcattctcatctctttctaatggtgaggcctgacatcatctggaactgaagagattctacaatgagctccaggtttcattctctcttccatgcgggcacagtctacctctcccttccatgcgggcacagtctacctctcccttccatgtgggcacagtctacctctccctttcatgagggcacagtctacctcagtcaaccagtctcaaatcttcagggtcgtgtaaacttccaggcccttaaaacctccgaacccaagttgggatcactgcactggggctgtctttgttcctcctgctttccctgcactgccattttgttcattcagcttcataaaacccgctgaaagaaccagtgtaatcatctttaaattagtcaaccaaagttgacactttcatttttaaacttttaaatctattatcctaactttagtaccctttatctgatccctaactttttaactttgagatttgacttcctaatttttaaaagtttacaataaaaaataattttgaatacatagttttacttgtacttaaaactgatgtgaaaaaagtaattaatttttaatgcttgtattttatcttaaagactggctgggcgcggtggctcatgcctataatcccagaactttgggaggccgaggtgggtcaatcacttgaggtcaggagttcgaggccagcctggtcaacatggtgaaaccccatctgaactaaaaatactaaaattagctgggcatggtgtggtgtgcgcctgtaattccagctacttgggaggctgaggcacgagaatcccttgaacctgggaggcagacgttgcagtgtgccaagatcacaccactgcacttcagcctgggtgacagagcaagactctgtctcaaaaaaaaaaaaagacgaatacaattttagatttaaaaaagaaaaagtgttaaaataattacttttaatttatgtagtgagaagaattaaaaagtaaataatatttgttttagctacagtacatagatcatatttgtcttatgaactttaatttttaaataacatgcacatgtacaatataaacttcaggagagtgggaactttatctccaatgcctgcaaaagtacctgatacttagtaggtgcttacaaatatttgctgacttaatgactatacaattcattggctacaaaatggtaaaaagtgaaaagtaacttttccttttatccctatagatacctggtttctacccccagaggcagtcgcaactttatttgttttgtctttctctagagatattataagcccacctaagcatgtgtatatctatataaagacagttagacatatatgcgtgtatgtacacaccatagatatccttttttctaccttcaaatgggaacatcttgtacatatttcctgtattctaccttttgcctcaactgtattttgggtgtaattttatatcaattttgggaaaactctctcttctttataaaagtgacatagcattccttgtataactgtgtcctcaatttatttgaccaatcttttattggtggtatttcaatttctagaattttgtgatttttttttttttctttagacagaagtttgttcttgctgcccaggctggagtgcagtggcacgatctcggctcaccgcaacctccgcctcccaggttcaagtgattctcctgaatcagccttccgagtagctgggattacaggcatgcgccaccatgcccggctaattttgtgtttttagtagagatggggtttctccatgttggtcaggctggtcttgaactcctgacctcaggtgatccacccgcctcggcctcccaaagtgctgggattacaggcgtgagccactgtgcccggccgaattttgtgatttttaaacaatgctgtactacgtgttcttgtatggatagcattgctcatacatatgagtgtttggaaaataatttttccttgtgcggctataacaaaacacttgagaccagataatttattaagaacagaaatttattttctcacaattttggaagctgggaagtccaaggtcaaggtgccagttgtctggtgagggctgccttctgcttccgagatggcaccttgatgctgtaccctctggaggggtagacgtgctgtgtcctcacatggcagaaggcagaaggacaaggaagccaaaacctgggtaaagcctatatatatatatatatatatatatatatattatatatatatggctttaaaggtgtatacacacacacacaaaggccttatatatacaatttacatacacatatatatacacatgccttaattccattcacaagggaaggagctttcctggccctcccttaacacctgaattttggaggtgacacattaaaaccatagcaatatcctagaagtaaaactgccatatcaaagagtaaatgcatttaaaattttaatgaatattggcaaattttcttccatggattatgtcagtttatacttccatcagcaatgtataaaagcaccattttccttcacactggccaacacattgctatcacattttgagatcattataatttatagttgaaaagcgatatcacactattactttaatgttcttttctttaatgtgaaatttattaattatcctcacattctaaaggcattaatgattacatttttgtaattgccagggactgtttacattttaccaactgatttttgccattattttcttccttcattttcctttcttttttccttccttccttccttccttccctcctttcttcctttcttttctttctttcctttctttcttccttttttattttttcttagacaggatctcacttgttgcccaggccgcagtgcagtggtgcaatctcggctcactgcagcctccatctcctgggctcaagtgatcctcccacctcagcctcctgaagagctgggaccacaggcacaaaccaccacacccagctaatttattttttaaaatgtatgggtctggggtctccctatgttgcccaggctggtctgaaactcctgggctcaagccgtcctcctgtcttggcctcccaaagttctgggattacgggcatgagccacagtaccctgcttcactgtttcctgctctattggtcataatttcactcattatttcctcactttttccctcacgtttctccacttcttcacctcgacggctttgcatgtgtaattctctgttttggaattgcctctctccagcctctccctccatcttcaattggaatcttaattccatatgcacagaatagctccaagtggtagtggaggggagaaacttgtaacaaggggtcctgggtggaagaactggcacacggggtcagagatttcagggaaacttacttttcactgcaacaccttttgtacctttgcatcttgtaggaagcttacatgtaacctctatacaagcaaacacaggcaaaaacacacacattgtcaattcacatccttatttgtcaaggtatagcttgaatgtaatttttagctaaaaagttgtttatctttactcttaacattcatggaaagtaactacatacgtataacatacctataagttgtataacatatacatttttatagaaaaataaacatatttcttttataacttgctaacttcttgattgagaatctctgattattctttgagtcctgccaacatgtctagcatatttcttaatcaatgtaggcattcaaaaactgtttaattcatttagcaaatatttattgagcctctgttctgggaaagtatcttagtaatcaccggcagtagaatttacagtcacagtccttgcccttagacatcccagttaatgatgaagataaacacagagataaataattctaataggtacaatttagagacatgcaaagaaggggaatgataaacatcaagtgattatttatctccgcatttcccaaggactgagtcaagtagcatcttctcatgataattttggtgatcaccaggaaagctttttattagataacgatttattgcagaaaatacataaaaaactaatacttttgcagagattaattttgtgtgaggttaaagtagacatttaatttaaagaagttagtcactgaaagtaaaatattcagtaaataagagtttcgacagaacatagccactgcaacagtagtggagcagaggtgagcacaaccgaggctgcggcaggagaatggcgtgaacccgggaggcggagcttgcagtgagccgagatcgcgcccctgcactccagcctgggcaacagagccagactccatctcaaaacaaaaacaaaaacaaaaagaaaaccaacaactgaagcttggcacatgttaatctgtcccaaccaggcacacattgccttggtaatgataattataattaaatattagtatagcttccctgtgttgagggtttactctgtgtcaagcattatgttatggactttatatctcatttaacagtcacaatctcccaaggacgcttatattttcttgagacaacagaggctgagagaacgtaatgaaatggcacagataactaaaagtttattctttaattgccatgcaactacacccagtaggagccaaatattggaggaaaggatcgctaaagattttgaccttgtaaattttgactttgagtgagaaaagcaagtgccagatgaataaataaccctttttgagaggtgctatgaataagtattatgagcatgcagggcaggagaggattggggatggaagccaggtcagggaagggttccttgaggagatgatgctgaagtgggctcggacgaatgcatcagcattaactaggcgttaacaaaggaagctctaagtggaagtgcctgggagaacacacacagaggcccctgtggtggagccagagagcttcacggtgccacggaccgtggtggagccagagagcttcacggtgccacggaccgcggtggagccagagagcttcacggtcccacagactgtggtcccagcgggcctctgtttctgcagccttgcccaaagtaggttgtcaacattttgaattactgacaaattcaagggtaagaaacgttatctccggtagatttagtttgcattttccttattaagaacatcttttataagcttaagaacaatttacattcttctgtaaactacttcttacattctttgcctattttcctgtttgtttcctcattcatttgaaaaagcatctcatagattaagttagtttcttgtctatgatataagacatatatttgctttctaatttaacatttatttcatctttattattttaaatttttagttatgtgaaaaattttaattattattattattataattttttttttgagacagagttttgctcttgttgcccaggctggagtgaatggaacgatctcagctcacctcaacctccgcctcccaggttcaagcgattctcctgcctcagcctcccgagtagctgggactacaggcatgcaccaccacgcccagctaattttgtatttttagtagagacagggtttctccatgttggtcaggctggtgtctaactcctgacctcaggtgatctgcctgtctcggcttcccaaagtgctgggattacaggcgtgagccactgcgcccggccttattttaaaagtcaaatcaatctgtgatttttgttgtttttgagtttaatatactgaggaggctaatatattccaattttataaaagtattcaactgtgttttcttttagcacttttatggtatcagttttgaagtgtaagtatgtgaacattgggatttattttggtttaaagtgtgaggtagagatacaattaatttttttcttcaaatagctcctcttgttgcaacactatttgtagaataatccatctttctcaattgatttgaaatatcacctttatcaatactagatttccatatgtatttgagtcttttactggacttcattctgtttcattgatgagtctatatcttcatattctagtaatactgtgttttcaatgttattattattattttattcatttatttatttacttatttgtttatttattttgagacggagtctcgctctatctcccaggctggagtgcagtggcccagtctctgctcactgcaacctctgcctcccaggtttaagtgattctcctgcctcagcctcccaagtagctgggattacaggtaactgccaccacgcccagctaatttttgtatttttagtagagatggggtttcaccatattagccaggcttgtctcgaactcctgaccctgtgattcatctgccttgacctcccaaagtgctgggattacaagcgtgagccactgcacccagcctaattattattgttttattatcttgtagggctaattacttgcataaagtatttctcagatttatacttttgcctgttattcttattcacttatttttccataccttcttcagaatcagatttctagtttaaaaaattcctgttaaaattgttattgagcattagatggaagcagcatgggtaggagccgtggggctgtttccgggagggtattccaggcctaatggccagcatgtgtcagggcctcgactggcagtgcgtgttgtgtgtttgaagaacaggggagttggagttactgcagcagagagttcagtctgaggaggggagatgggagataatgccctagtgggggtggaggtgggacatgagggtccagatcacccttggggcccttgtaggccattataagactctgacttttagtctgaatgagatgaaaagtccctggcagatttacagcatagaaatatcatacaaaaatttggggcagggtgcagtggctcacacccataatcccagcactttgggaggctgaggcaggcagatcatttgagcccaggagttccagaccagctttgacaacatggcgaaaccccttctctgcaaaaaaatgcaaaaattagctgagcgtggtggtcctcgcctgtaatcccagctactcaggaggctgaggtgggagtcactttaacccaggaggcggaggttgtagagagttgagatcgcgccactgcactccagcttgggcaagacagcgagacccttatcaagaaataaaaataaaaaataaattttattttattttatttttctatctgttaaatatccaaccaattcatttctgggcatctatctgaaatattcaacatacgccaccctactcccgcccccaccccaacaagagaaagaaaaagcattgtagaaagattattacagcacagcttgttacagtgaaaaactgacagctaaaatgcatattaatagagaaatgattttaaaaatctgtgctgtgcccgtactatacaatactaacatgcagttaaatgcacagaataagtttgaaagcgcagaaaaataaatagcgctcttatgagaccgggcgcggtggctcacgcctgtcatcccagcactttgggaggctgaggcgggcggatgacctgaggtcaggggttcgagaccagcctggccaacatggagaaaccccatctctactaaaaatacaaaattagccgggcatggtggtgcatgcctgtaatcccagctactccggaggctgaggtaggagaatcgcttgagcgaggcagaggttgcggtaagccgagatcacgccactgcactccagtctgggcaacaagagcgaaaataaaaaaacaaacacaaacaaacaaacaaaaagaaatatagctatcacgttgacaacaaagtggtacataagggaggctgtggcttggctttggagctgctcaccggaatgtccgtggtgcagtgacggcgtccacgattcgggtcagagctctccaggacaggtggggtagagctggaacaagacgggcaggtgctggcgctcactgaggctactctggcaacacatgaggacgcattttatttttctccccacttttaatacgtttgaaaattccataaaagtaaaacaaaacaaaaataataaaaattcattaaagactgaaccataaaagtcagaaaatttttccacaacagccttggccattgctgtattgtgcattgaaggcggctcttagtgaagagacacatttgtaataaatgttttgatgtactagacaatcagggctctgaggattgaatgagatgatccgtgtaaactacttagcctggaattctcaggacatataaatctaaaagtttttatggaagttgattttattactcaaaatatattacagtaattttgtaaatctattttatctctctatctctatataatttgtcttctgtttaatagctacagaatgtttcttaatttatttagccattcccctattgaccttttctccttttataacaattttgtaataaatgtctcataatatgtatttgtgcacctgcccaattctttccatgaggtaagtcccagaactggatatggtaaacaccaatgcattttcatatatcttttttccaatttgccctgcaaagagattgtactcatatacacaccctccagttaatggtggcagtgtctgattcttcacacccttgtcaacaaggaactagacacatgcattattagtgaaggcaagtgcatatggactgtgtatttttgtctcttccaaggtgaaatacatttttatgtcctcaacttgttttgtattggattctttgtcttttctttattgatgtgttagaactctttatagtaagactattaatattttgtcacatatgttacagaacattttctctagtttgccatttgtctttaatttcatgtagttttaaatatttcagccttcattttaggctatctgggatttattgcatgcttagaaaagccttttatatttcagaattaaaaagctttttttggtaaactctttcacactgttggattttgtttgaacttctgtttttaagccatctggcatttatttttattttattttactttattttatttttttatgattttttaatttttttattgtactttaagttctagggtacatgtgcacaacgtgcaggtttgttacgtatgtatacatgtgccatgttggtgtgctgcacccattaactcgacatttacattaggtatatctcctaatgctatccctcccccctcccgccaccccatgacaggccccaatgtgtgatgttccccaccctgtgtccaagtgttctcattgttcaattccccacctatgagtgagaacatgtggtgtttggttttttatccttgcgatagtttgctgagaatgatggtttccagcttcatccatgtccctacaaaggacatgaactcacccttttttatggctgcatagtattccatagtgtatatgtgccacattttcttaatccagtctatcattgatggacatttgggttggttccaagtctttgctgttgtgaatagtgccacaataaacatatgtgtgcatgtgtctttatagcagcaagatttacaatcctttgggtatatacccagtaatgggatggctgggtcaaatggtatttccagttctagatccttaaggaatcgccacagtcttccacagtggttgaactagtttacagtcccacccacagttttactttattttatttagagacagggtcttgctctgttgccaagcctggagtgcagtagcacaatcatagctcacttcagccttgaccccctgggctcaagcaatcctcctgcctcagcctcccaagtacctgaggctacaggcacatgccactattcctggctaatttttaaatttttttgtagagacagggtcttgtccaggctggtctcaaactcctggtctcaagcaatccttctgcctcagcctcccaaagtgctggaattataggcatgagacactgggccaagcctggaatttgttactgcagttaggatatatgttttattcctaaatgtagcctactgtcccaacctgttaattgaagagtttattatctatatctggttgggattctccatatcattatttttcttttaggcacttttattggctattttcatacttactatttcgtgtactttagaaacagtttttgcattccaagacaattctggagagactatttttggactcacattggaaattaggtgagaattggcatttgtctttatacaagtgttccacttaggaaaattgtgcgtcctcccacttttaaagtcttttaagtaagtcttattttttatatatatgtatatattatacatatatataaaatatatatattatacatattttacatatgtatttttacacacacatatatatatatatacacaaatatatatatatatatatacacaaatatatatatatatatatatatatatatatatatatatatatatatatatatatttgagacagagtctcactgcgtcccccagggctggagtgcagtggcgcgatcttggctcactgcagtctctgcctcccaggttcaagcagattctcctgcctcggtctcccaagtagctgggattacaggtgcccaccaccacgcctggctaatttttgtatttttagtaaagacagggtttcactatgttggccagggtggtcttgaactcctgacctcgtgatccacccgttttggactcccaaagtgctaggattacaggcatgagccaccatgcctggctgaagtaagtcttatgattaacttccccataaatctttcacatttcttattaattcctaggtattttataatattgaaggttttaaaaaatttcagagatcatttttgccattctattttttaacttagttaccactaagacaacatctacaaaatgctgtagatctctgcgcacacacaaacacacacacatcatgcaacaaataagaaaatgccaatacatgaattatacgtgagatgttggatatattattttattggcacatgtcttagaactcattacacttctaggtacatatccatgagacaccaatgcatgcgaccatcaaaaacatgaacaataatatttacagaagtttcattaacaataactaaaatttagaagcaatctaaatgtccaccaataggagaacagatgagcaaatgggatacgatacagacagaagcaacaataataaaatccctactgatgtggatacacatgaaaaatctcatgaccctcatcttgagcaaaagaaacttcacatcaagaaatgcatactcttttattccatttatataaagttcaagaacaggcaaaactaatcttgtaataaaaatcagggccaggcatggtatctcacacctgtcatcccagcaatttgggagaccgaggcaggcagatctcaggagtttgagactagcctgggcaacatggcggaaccctgtctctaccaaaaatacaaaaaaaaaaaataagaaattagctgagcatggtggcacgcatgtgtagtcccagctacttgggaggctgaggtgggaggatcgcttcagcctgtgtgacaaagtgaaaaaagtcagaataatggctatctgttgagagattaggtactatctgggaagggtatcagatgaccttggagcctgttggacattttttgaatcttgatctaggtggtaacgtcactggtagataagcactgtatataaaagctcattgaatttacacttaagatttgttcacctgattcaatataaaatttacctaattttcggccagccgccccgtctgggaggtgaggggcgcctctgcccggccgcccctactgggaagtgaggagcccctctgcccggccaccaccccgtctgggaggtgtacccaacagctcattgagaatgggccaggatgacaatggcggctttgtggaatagaaaggcgggaaaggtgggggaaagattgagaaatcggatggttgccgtgtctgtgtagaaagaagtagacatgggagacttttcattttgttctgtactaagaaaaattcttctgccttgggatcctgttgatctgtcaccttacccccaaccctgtgctctctgaaacatgtgctgtgtccactcagggttaaatggattaagggcggtgccagatgtgctttgttaaacagatgcttgaaggcagcatgctcgttaagagtcatcaccactccctaatctcaagtaatcagggacacaaacactgcggaaggccgcagggtcctctgcctaggaaaaccagagacctttgttcacttgtttatctgctgaccttccctccactactgtcccatgaccctgccaaatccccctctgtgagaaacacccaagaattatcaataaaaaaataaattaaaaaaaaaaaatttacctaattttataaaaagtaagcttcctaataggcttctgtatatctagtcatgaaataaaagttaaaataaggctgagcgtggtgactcatgcctgtaatcccagaactttgagaggccgaggtgggcggatcacctgaggtcaagagttcgagaccagtctggccaacatgatgaaatcccatctctactaaaaatacaaaaaattggccaagcatggtggtgggtgcctgtaatcccagctactcaggaggctaaggcaggagaaccgcttgaacccggaaggcggaggttgcagcgagctgagatcgcgccactgcactccagcctgggcaacaagagtgaacctccgtctcaaaaaaaaaaaaaaagttaaaataaaacaaaagcaaaagactctcaaaacaaatcaaagagcagccaaataagcaactaataaaaagaaagtcattgtctggcttgtgcccaaaatgtactcatcagtctaagactcagatcattctaagcaccaatactttgacctgctttctatggagacccctgactattcaacttagcacatccccagaggacctttcctctacacttggctcatcctctgtgctccgtatttctcttcctgacatttctatctgcccgtctcccaagccacaaattacagcatcccattttacactctataataactgaatatcgtctcatatcaatctcttagcccttttactaacactgtcttcaaatggggtacaaaaatagctttctaatagaatcctcccaacccaatttctggctccagcatattttgcaaaaggctgtcagtttgatttcctcgcacagtgcttctggaaaggatggcagtgttgtagacctgctgcatctgatatggtcactgctagccacaggtggctactgggtacttaaatgtgctcagctggctgaagaactgacgttttcatttcattttgttttaatcagtttgaatttagttaagcacatgtggctagtggctagtgtgttggtcggtacagttctagaaggaaagctctgagctgtgcccctctctccaggtggaattagattttatatattcactgactcaggcctgagcaggactggtatcagcctaacggcccctcttcatccaatacaaacataattttgcatatcagacttcaagctgcatttgttcttttaattctcctcaagtaattgtataggaacctttttttttttttttttttttttgagacagagtcttgctgtatcgcccaggctggagtacagtggtgtgacctcggctcactgcaacctctgcctcccggttcaagcaattctcctgcctcagcctcctgagtagctgggactataggcgcaggccactacgtccagctagttttttgtattttttagtaaagatggggtttcaccatattggccaggttggtctcaaactcctgacctcatgatccactcgcctcggcctcccaaagtgctgggattacaggtgaaagccaccacacccagccaggaactactttttaatgcaagcgtctttctcactgctgaccatggatcctggattatttttaagtggctgggcccggttctacagatatatcaaaaggctcccaatctctatgcattatgtccatttgaaaggcactatacttggccaggtgtggtggctcacgcctgtaatcccagcactttgggaagctgaggtgggcagatcaactgtggtcaggagtttgagaccagcctggccaacatggtgaaaccctgtctctattaaaaatacaaaaattagctgggtgtggtggtgcacgcctgtaatcccagctacttgggaggctgaggcaggagaatcgcttgaacctgggaggcagaggtggcagtgagccaagactgagccactgcattccagcctgggcgacagagcaaggctctgtctcgaaaaaaaaaaaaaagaaatgcactttctggccaggcgcggtagttcacacctgtaatcccagcactttgggaggccaaggcgggtggatcacgaggtcagaggttcgagaccagagtggccaacatggtgaaaccctgtctctattaaaaatacaaaaattagccaggtttggtggtgcacgcctgtaatcccagctactcgggaggcaggagaatcacttgaacctgggaggtggaggttgcagtgagccgagatcacaccattgcactccagcctgggcaacaggtgagattccgtctcacaaaaaacaaaaaacaaaaaacaaaaacaaaagaaatgcactttcctggaaacttcagcccaaaatagcaaaattaagtgtgattgaaaccaggttgtattgtctatcatatgtacagataagcaaaaattataaacaacataactggattcaataaaaacttgggtaattcatttatgggaaaccaatagcctgtagccatgtagctattagaatgattagatttgtactgacacagaaagatgtatcaaattataatatgaaatcagcaggatctaaaattctaaatatcccaattctactttatttttaatataaaaatatgtatacaatcatacagaaataaatagaaagaaaacacattaaaatgttagcagcactggtttatctccaggtggtagaatttgatgtagccaatccaaattttctctataactggtattaacactctttaaaaatgaaaacagatttcaatattaaaatattcagtatacttctaaagccagattttttttttttttgaggcggagtttcactcctgatgcctaggctggagtgcaatggcaccgtctcagctcactgaaacctccacctcgtggattcaagtgattttcttgcttcatcctcccaagtaactgggattacaggtgcccaccaccatacccagctaagtttttgtattttcagtagagatggagtttcatcatgttggccaggctggtctcgaactcctgagctcaggtgattcacccacctcagcctcccaaagtggtgggattacaggcatgagtcaccgtgcctggccagatattctttacattttgaattagtggccaggcatagtagcatttccctgtagtcccagctacttaggagtgaggtgaaggtgggaggatcacttgagcccaggagttctaggctgcagggagccgtgatttgtgccactgcactctagcctaggtgacagagcaaaaccctgtctctaaaataaattaaaataaaaattctgaattagtgactgttttctgtaaaattcggagctacaacaccaggcgaaccagaagccccacgtataaggttttaattatttaacaatggccattttcttttcttttctttttttttttttttttgagacagagtctcactctgtcgcccaggctggagtgcagtggtgggatctcggctcactgcaagctccgcctcctgggttcaagtgattctcctgcctcagcctcctgagtagctgtgattacaggcgtgtgccatcatgcccagctaatttttgtatttttagtaaagacggggtttcaccatattggttaggctgatcttgaactcctgaccttgtgatctgcccatcttgtcctcccaaagtgctgggattataggcatgagccatcacgcccagccaacactggccattttctaatagagattctgaaaaaggaaatatgtaagactctgtatatagactctgtacacagactctgtatataagtatcagtctctgttgggagtgccattctaaggaatgattaccaattctgaaattcagaaaaggatctatgtaaacataacaaccgaggccaggcacggtgcctcatgcctgtaatcccgcactttgggaggccaagcagggtggatcacttgaggtcaggagtttgagaccagcctggccaacatggtgaaaccccatctgtactaaaaatacaaaaattagccaggtgtggtggtagatgcctataattccagttacttaggaggctgaggcaggagaattgcttgagcctgggaggcagaggttgcaacgagctgagatcgtgccactgcactccagccttgtgacagggtaagaatctgcctcaaaaaaaaaaaaaaaaaaagaaaaagaaaagaaagaaagaaagaaaaaccaattgaaaagagaaaaaaactattcattaaaggaggttttttttttttttttttttaacaatctcacagtgtcacagtggggaggatttgtccaaacataacgcaaacttcaaaaactacagaagatttgactacttggcaaagaccacaagaaaaaccatcaaaacaagcagctgagagaaatctgcaactgacatcatagacaaaggattaacttccttaatctgtaaatactgtctgtaaaccaagaaaactagacaatgcaagtatacacaagttatcaatacaagctgggtgcagtggctcatgccttgtagtccctgcactttgagaggcagagatgggaggatcacttgagccaatgagtttgagaccagcttggggtgcatagtgagataccatctctacaaaaaaaaaaaaaaaaggaaaaaaaagacatataggctgggcacggtggctcactcctgtaattccagcacattgggaggccgaagtggacagatcacctgaggtccagggttcaagaccagcctggctaacatggcaaaccctcatctctactaaaaatacaaaaattggccaggtgtgttggcgggtgcctgtagtcccagctacccgggaggctgaggcagaagaatcacttgaactcaggaggtggaagttgcagtgagccgagatggtgccactgcactccagccttggagacagagtgagactccgtctcaaaaaaaaaaaaaagatatataaatacagaatagtagttatttcagggaggaagggagacaaaagcaatcagggagaagtccacagaaagtttctaaggtactagttaatatcctattctttgttgtataaactaggtgacgggtacagaggtgttttattattcttaagtctctttgtgtgaacatgtgtatgcgtgtatatacacatacatttacacacactaatatacatgcatatattctgtatttagagtaaaaaaaaaatcacatgcattaaagttttgattacaccacgggctggagtaaaggggaagagagacttgcaagtaaaaatgtatgtgagcatttctctggagaactatgacatctataaaaattccaatgcacataatttttgatccagtatttctacctccaggaaattcactccacatatataactgcacatgtattatatgaaattacattatacaaatctatttattgtaacatcatgtgttttagtgaaaatttgaaaacaaattattgacagggagcctaatatataaaacacactactgtgcttttgaatacacatgcagctgtagccacacacacacaaacacacacacacacacacacacacacacacacacacacaaagtctttagatagaatttcatgagatcggccggaggcggtggctcacgcctgtaatccccccgctttgggaggctgaggcaggcagatctcctgaggctgggatttcaagaccagcctggctaacaaggcgaaaccctgactctactaaaaatacaaaattagccgggcgtggtggcgcatgcctgtaattccagctacccaggaggctgaggcaggaaaattgcttgaacccaccagacggaggttgtgtgagccgagatcgcgccactgcactccaacctgggtgaaaatgagactttttctcaaaaaaaaaaataatttcataatatattatttggggaaaaatatatagaaaagtatgacataattggtttattaaaaagaaatatatacattcagactctctgtagagggatatctgatagagaaatagatatggaaagtgtattatctattcaagaaataagttttaaaaacaagtttccacatagacttgtaatttaatgatcataccaaattaactgcatcttgtgattatacgtagaatgatttcagtcacacaaattaaaaccttaacagaggaaagggaattgcaaaaaatattctctatcaaattaattatacttgtattggggtaatgaaactcagaggggcagttcatatttctccatttttataatgaaagttcacagatttgtaatacacttagtgtgtttcataagctataatagagagttgtcctgacaatatttgaagaaaaatgacattagttccttcctcctgtgtaggaaaaacattcagttgctcttccaggtcattcaacaaagaccttttctttcttttttctttttttttgagaccgaattttgctcttgttgcccaggctggagtgcaatggcgcgatctctgctcactgcaacctccgcctccctagtgcaagcgattctcctgcctcagcctcctcagtagctgggattacaggcatgtgacaccatgcccggctaattttgtatttttagtagagtcggggttttgctatgttagccaggctagtcttgaactcaacctcaggtgatctgcccacctcggtctcccaaagtgctgagattataggtgtgagctaccatgcctggccatgaccttttctttttttaacctcagctttttattttgaaaaaagccaaatctcagtaaagttgaaaaagaattctaatgaccatctctacatatgtccatgttttgcaaaattgggcttatcactttctcgctgttctcagacacacatacacattcaggctcttgttttgatttgacaaaaatcagataactctgtgtagtcctcagtcctcacagtattctcagatggcagcgttacagagcagccagggttcagttgtgaaccaaaagaactgttctaactcctcccccaccctcaggaggaaagcaattcactggagacctgtatatccattctagtctaccagagagggcctgggacagaattgtatggttacagtaagctgaggaggtatcttttcgttgattcaccaatatgttctgaattgggactctggtatctaggaacacatattccaatggtagaagatcattcttttatatgatgtgaccgagtacaggagatgtatcttatggctaggaattttctgtgtaaacccatgcatcagagaaaaagatgaaatcagatatatacctttcactgagggattatcaatccatctctaggcctcgaattccttactattatttagaacatcgtcaacctgctgttgaaaatgaaataaacatcttctgcaaagtttatttattttttattttattattattttttttttgagacagagtctcgctctgtcaccaggctggagtgcaatggcgcgatctcggctcactgcagcctccgcctcccgggttcaagcaactctcctgcctcagcctcccgagtagctgggattacctgctcaatgctgttgtagcagagggggaacatccccagggagctgcagactggtgggaagagcaggcaggcacactcgacacagaagcccagacaaacccttggtatcatgagtggctcaaggtcagagataaccaggcccgtacatgctgtctttccacgtcagacttgtattgatgctatttaaatcataaaagccaccagctccatggagttcccagggaggcagttctccttagtacttcctggtcactcggtggtcagagctgcgggcacacaggctcaagccactccacatgtcagtcgatattgcaaaccatacatcatagtatacctaattaatatatcaatgttggccgggcgcagtgtctcacgcctgtaatcccagcactttgggaggccgaaacgggcggatcacgaggtcaggagatcgaggccatcctggctaacaccgtgaaaccccgtctctactaaaaatacaaaaaattagcagggcgtggtggtgggcacctgtagtctcggctactcgggagactgaggcaagagaatggcgtgaacccgggaggcgaagcttgcagtgagccaagatcgtgccactgcactccagcctgggtgacagagtgagactccgtctcaaaaaaacaaaacaaaacaaaattccacaacaaacaaagtagcatttaacaccaagagaaaggggataggaaagagcgttaatgaaccagtcccaaagaatctcctggtctggcccaggtggcccatcagtcttgcaaggaagagtctttgatgtgggcagagcctttggtggtagattctgggtaccaattaccagtgacagcaagatggggtctgttaagatggctgtttcgagctggtgaagtcctgctgtttgatagccccagagtcctctggtgaggactgattgtggaggagtgtgcctggtgatgcccttatctggctggatgcactctttgttgatcaggtgaaacatttggtccctgttggcaaagtgctttgtgaaatagaagatggagtcttttgttaagatggaattacttatgtcaatggtgttgtatacacttgacaaggccagatgacattcccaatttgtttttataaatagtagagaaacttcgctggaggaggagggtcacacatagcaagagcagagggcttggtgcatcttccattccagatgctactgagaatgtgcaaatcagtgtcacgacggatcccaaaggtttcatttcaaactgagccatggacattttatagtgcctaacttactattcaaaaatactcacacacacagttttgtttgtaacatttccactcatagaaattccacaggctttggtataggaagtgtcagcggaacacacctttaccctggggtaaaaagcatagtcttccctcacagttaatgctctcaatcttctgattctgggtgtctggtagatcttgtgtccccagaggataaatcaatgtattttaaaagtattaataatcagtttacagccatgcattgttttataatggggacatatgctgagaaatgcatcattaggcaattgtgcattgtgtgaacatcatagagtgtacttacacaaacagatggtgtagcctcctaacacacctagattatttggtacagcctattgctcctaggtacaaacctgtccagcatatgactgtactgaaaatgtaggctgaaaattttattttacatatgtaggcagctgtaacacaatgtaaatatttgtgtttctaaacctggaagaagcacagtaaaaatacagtattataatctcatgagaccaccgtcgtatatgtccgcagttgactggagccgtcattaggcagcatatgactgtagtccattaattttaagtattcaaaacaatttccatccattcacaattcaaacaattgctcacaattttgtacagctattaatccaggaaaccattagcctaggaagccaaatgtttagttagacacaagtttagggaaacatttgagtattgctggaggacaaaagcactcactaaataaccagtggctgattaccggcctctggaccatggccagttggaatagctccatgtcattctttctttctttctcttttttttaagttttgttattacaagaataattttctatattagactgttttcactttattaactttatcataagtatgccaacttctgcaaacttggagcaattgcaataatctattgatttattttcaccaaattttcactttatttgcccagaattcaagcttgtctgttaatttcccaggtcttcaatgacttgtctcttattggctagcatctccttattttccttgttcaattagtaaggttttccttattatattacttttttggggggcctttctctgttagtatatagattttctcctgagagctaaaaatcttcataacaccttagtcaatatacctttgaaaaaaccccttatattggctggttgcggtggctcacacctataatctcagcactttgggcggccgagatgggcagttcacctgaggtcaggagtttgagaccagcctggccaacaaggtgaaaccccgtctctactaaaaatacaaaaattagctggatgtggtggcaggcacctgtaatcccagctactcgggaggctgaggcaggagaactgcttgaacctgggaggcagaggttgcagtgagccaagatcacaccactgcactccagcctgggtgacaagagcgagcaaaactctgtctcaaaaaaaaaaaaaatcccttatattataattgtcattgaaataatctgacattcctagtaacctctgacactaaaattttcttcgcttttaatagaaacacaattcatcatttatccattatccattgttttgaatttaatttaattcaccaaaataatacatatattttagtaccaaagatcaaaaagtgctcgaaggtttataattaaaaaaaaaaaatcctctcttctcccccattccggctatctagatacagtcatgtccaactctcagttctttcttatagaatatgcatgatattccctcatctttcatttaagttaaggaatatcatgtatattctataagaaacagaatgaggcattctatttctatttccttagaaatagaaattggaaatagaaatctaaattggaaagattggccagttgcagtgactcacacctgtaatcccagcactttgggaagccaaggtggaggactgcttgagtccagaagtttgagaccagcctgggcaacagagcaagacaccatctctacaaaaaggtaaacaattagctgggcgtggcggtgcaagcctgtagtccacgctacttgggaagctgtggtagaagaatcccttgagtccaggaattcaaggctgcagaatgggcagaatgactgtgccactgcactccagcctgggtaacagggtgagaccctgtcgaaagaaaagaaaaaaaaaaagaaagaaaagagaaagaaagaaggattatcttttaccttttacttgctacagataacttccctgccacctcattccaatatagtcaaagcaacattttattaagccatcaacacctttgttttttatggagttaacagttctctctatatatatttagtttttttttcctagtgtaccaaacacagattcatcccttatactgtcctatggagctataaagcttttcttgacatagccaaacggctaggaaataatcaattctatttattttttccttcaaggtacccttctgtgaatcttccaccttttgttctaattagggccaactgatgctgtcgtcctgggaattttcccattcaccatcactttgctaattccttcacctctttgctttcctgtactcaggagacatccttggcaaaacttaatggttgctgggtcatgatgaaatattataggcatactagagaagctgcttgattaagtagccatcagttcgacaaaacaaaaaacaaaaacaaacaaaagctaatttgtagagttttttagataaaattgtcctgtgaaacttcaaaatcaagcttcctcatctgttcattaatgctgagatctttgttttgttccttcaggtaaggcaaatacccgacatacagggattgtttaataaacactttctgggtttcttgttcattcatttaacgcctttgccatcatggggtttccattccagacaggaagttaaatacataatgttaaatcaggtcatgattaatgctacaaagaaaataatgtagggtaagaggtaagagaatgagtggggattggagagaatgttcagggagggcgctctttgtggaggacagatcaagaaaggcctgtgtggtggcagccagctggagcctagcactgcggtccagatgaaagatcacagcctcaactagtgtggtcaaagggaggatggcgagtgtttgctgagggacatatatggatggtagagctgacagtctttgctgatagattgaacacagaatggcagcaaaataaaggatggctccaaagtctgtgctgtcagaatgagcccctgaagcttttagaatgcacggggtgcctgcgagggtggcacatttgggaatctagttggctctgactgaagctatggagaaacgtggcaaagaagtgaggaagaaaggatgctgaggcgggcttaggaggccctttattaaagcctggctgtgtttataatcgcaggcaagaagggaagctaatgtagtaattcagaaggatgaagagaactaaattgaggaaataggttttcatttttatcaagcaattcatcattgactacgactccacattaattcagctctacccataaagccaattaaattaccccaagaaatcaataaaaacacaggcagggtggggaagacattcttgatgaacattcacacgtcttttttataagtatttgggaagagatttcgggctaaaggggtgaagcatgttccctacatcactgtagacctaggaaacgaattctatttctccttttccctccatacaagcaatctaactccacaatgaagatagggacagcacattctcaggggaaattgacatggacagttcctggactatagctcactcctatctgaagctctgaatgttaacatccaatgtaggaacagcttttagcttcagaaattccacaggccaaagaacaatgataaccattaagaagattgcaacaggagcttttacctccaccctctttttcaaatacaaagttctcttgtatctctgagtatctggaatgaccacatagttctcctatctgaaataagacagacacacaaaacagggtaatctagctgaccagagagtgctgggataaacacaaagctcactaaaacggttagggaggggaaaagcttattcacatagttttaacttttttttttttttttgagacagtctcgttctgtcgcccagggtggagtgcagtggcgtgatcttggctcactgcaacctccacctcttgggttcaagcgattctcctgcctcagcctccagagtagctgggactacaggcgcccgccaccacgcccggataattttttgtatttttagtagagacggggtttcaccatgttagccaggatggtctcaatctcctgacctcgtgatctgcctgtctcggcctcccaaagtgttgggattacagacgtgagccactgcgcccggccaatgtttgtatttttagtagagacggggtttcaccatattggtcaggctggtcttgaactccggacctcgtgatccacctgcctcggcctcccaaaatgctgggattacaggcatgagccactgcacccagcctggttttaacctgttttttaattaaaaattttattttacataaatacactttttgaaaataattttaagtttccatcaacggcttcctttgagtaatgtgaacctcacttccacatctttgccaggcctcgacttccccaactctcccctccagtgagcctgttatctgtctgcaaatacttttaacgagatacaatttgtgtggttggaaagaataaacagcccaggtttcaagagtctgaatatcactctctggagattttgaatgtattggctctatttctgactcagttaaaaaaaaaaagtactgccacttagggtagatgaggtcatagaaagcattctgaaccttccctggcaggtagcaaatgtacgacaaactgaaattgctattttgaaaggagaagcaatatttacatttacatcctttctatttatcattctaccacatccatctatcattacagagaattccttcttctcatgtgaggttaaatttccaatctcatacttgattttttccaggtcaaaagtctcattctcttatatatgttccaatttgtcgaggcataactgaaatgcaaatttacccatgttttgccgttacccacctacgtgttttttaacttccatgtaccattgataatatttatcacattccagtcagaaaatccgaaaaatcaaagcttcaaattccttccttattccctgtgaattcttatctcctctctatcctgtaattccttttcctgctttgtgcaagatcaaaaaattaactgcagtgaggtcacttacctctctccttctttcagccctacacagactatttcaagctgactgccctgcctttccattgaagacagaaggagctggtctagattcctatgagctgtgagatttcctgagcctctcccgctaatccttaacccagaaatgtattcgtcatttggctataaaaaaactcacagcttgacatccctgcacatgtaagagcactttttccaagttataactacagaacaaaactagatattctactttattgatacatttgttgtccaaggtacatttaccatatacaaatacagagacatcttttcagtgtagtgaggtaatcccaggcgttccatagcactggaggccccactggccaaaggcttcctaggtctacttagctcaaatatccaactcttacactttcttttttttttttttttgagacagggttttgctctgtcacctaggctggagtgcagtgacttgctcttggctcactgcagcgtcgatctcccaggttcaagtgatcctcccaccgcagcctcctgagtatctgggactacaggtgtgtgccaccatgccaggctaatttctgtattttttgtagagacaagatctcgccttgttgcccaggctggtctggaactcctggactcaggtgatcctcctgccttggcctcccaaaatgctgagattacagatgtgagtcaccatgcctggccacttaccgcttttatttatttattttttttttgagatggagtcttgctctgtagcccaggctggagtacaatagcgtgatcttagctcactgcaacctctgccttccgggttcaagcgattctcctgcctcagcctcccgagtagctgggactacaggcgtgaaccatgatgcccagttaatttttgtattttttaaatagagacggggtttcaccatattggtcaggctggtcttaaattcctgaccttgtgatctgcctgccttgacctcccaaagtgctgggattacaggcatgagccactgcgcccagcccacttatcacttcttaaagctacttccaattatactttgcccaattaacaatcttcctaatacagctgtttcattataactaatccctagcaccatcaacacatttttacatttaaacagtaaaccgtacactacaccagagccactgaacaaaccgcctgttgttttctatttcttgcttctgccaactttgctgtttgtcttggttggatattgtaatcaactaaggagctttgaaaaaaaatgatgcctagttttcaaccccaaagattctgatataattcttgtggagatatggtttagatattaggatttataaaaacttctcaggtcagccgggtgcggtggctcacacctgtaatcccagcactttgggaggccgaggcgggcggatcacgaggtcaggagttcgagaccaacctggccaagatggtgaaaccctgtctctactaaaaatagaggaaattagccaggcttggtggcaggcgcctgtagtcccaactactcgggaggctgaggcaggagaatggcgtaaacccgggaggcggagcttgcagtgagccgagatcgtgccactgcacgccagcctggggacagagcgagactccatctcaaaaaaaaaaaagaaaagaaaaaaaagaaacacgtgggccgggcgtggtggctgacgcctgcaatccaagcattatgggaggctgaggtgggcggatcacgaggtcaggagtttgagaccagcctggccactatggtgaaaccgcgtctctactaaaaaatacaaaaaactagccaggcgtggtggcgggcgccagtagtcccagcaactcgggaggctgaggcaggagaatcgcttaaacccaggaggcggaggttgcagtgagccgagattgcgccattgcactccagcctggcgacagaacaagactctgtctcaaaaaaaaacttaggggtagagcaatgtctctcaacattttcgttacattagatacaaaactggttaaaaccccacaaggctataaaatgaaaacctttgagatgatctttttctaccagaccgtctacagattttttggacttttttccttaatcacttcctccctcatgaaattttactaccacatacatactgcatatgtttatggactgggctcttttggagggccctagccacagtaatatataagacttttttcacctctcatgaaccgatttttaccaattgaactcatgggttagaagtacaatcatgtgtgtgtctccccagttcctgagaaatgcatccttaggcgatttgtccttgtgcaaatgtcagtgtacttacacacacctgaatggcactgcctgctgcacccctaggccatatggtatagtgtagcctgttgtccccctgggctatatggtgtagcctgttgcccccctaggctatatggtgtagcctgttgcccccctaggctatatggtgtagcctgttgcccgcctaggctatatggtgtagcctgttgcccgcctaggctatatggtgtagcctgttgcccccctaggctatatggtgtagcctgttgccccctaggctatatggtgtagcctgttgcccccctaggctgtgtggtgtagcctgttgcccccctaggctatgtggtgtagcctgttgcccgcctaggctatatggtgtagcctgttgccccctaggctatatggtgtagcctgttgccccctaggctatatggtgtagcctgttgccctctctaggctacaaacctgtacagcaggttactggactgcatactgtaacacaatggttttgtgtatctaaacatagaaaaggtacagtaaaaatatagtattgtaatcttgtgggaccaccatcatatatatgatctatcattgaccaaaacactattatgcaacacttaactgtatacatttaggggtcactgctgaggagttgatagttttggctgtggatatgaggttcacttagaagtgaatgagaagtgagatcctaggaaggaacatgaagtatttactacatatttaaaaggaaagatgcatttggcacaatggtaggaaaatgaggacagtgcacatcctataggtcaaggaagaatatattaaggataaagagattaatagcattgactacttctgagagcttgagtaatatgaaatggaagtggccgggtgtggtggcttacacctataatcccagcacttctggaggctgaggcagatggatcacctgaggtcgggagtttgagactagcctgaccaacatggagaaaccccatctctactaaaaatacaaaattagctgagcatggtggcacatgcctgtaatcccagcttcctgggaggctgaggcaggagaatcacttgcatccgagaggcagagattgtggtgagccgagattgcaccattgcactccagcctgggaaacaagaacgaaactccacctcaaaaaaaaataaatacataaaataaaatcagttggatttagcaatatggaagcgattaagacctgtaggcagaaagagacagaaagcaaattggactgaacacaggaatggatagcataaaccaacacacacaccagagtgcatttgggaggccgaggcgggcggatcacgaggtcaggagttcgagaccagcctggcctatatggtgaaaccccatctgtactaaaaatacaaaaactagccgggcgtggaggcacatggctgtaaacctagctactcaggaggctgaggcagaattgcttgaacccaggagaaggaggttgcagtgagccgagatcacgccactgcaccccagcctgggtgacagagcgagactccgtctcaaaaaaaaaaaaaaaaaaaaaaaaaagggagatatagtcttttttttttttttttggagacaacatctcgctctgtcgcccaggctggagtgcaatggtgcaatcatagctcactgtagcctcgaacttctgggatcaagtgatcctcccacctcactcttccctgtagctgggaccacaggtgcaagccaccatgcccagctaatttatcttttgtagagacaatgtctccctgtgttgcccaggctggtcgcaaagccttggcctcaaggtgtcatactgcctgggcctgctgaagtgttcatattacagaaggaaccaccacgtctggcctacattagctttttaaaagttaattttagaaggtcctgattgaggaatagtttcaatattgaaaagagaaaacgaatcacctatagcaggggtaggcaaactgtggcccctgtttttataaagttttattggaagagtagagccacatgcattaatgtaagcactgtcctggctgtgtatgcactagagcagcagagttagtttcaagagggacagtacgaccaataaagtctaagatattaattacctagttttttacagaaaaagtttgccaagccctgatctccaggtgaggatttcctaaaagccctcaggaatttggaggaaatacaaggtaggaaaaaattggtttattgcaagacagaagaaaggagaaagaataggtgaaggtgaatttgcaatttgttgctcaaaagatgagaaatgttgactgctgggctccttgaaagattgatcatccgaaaatcctgttgatcgaacaaagctttagagctttgacagagtcaggctctctgtcataagcacacaacctgacagtcttatcagtgtgtcagatggagaaagaggggaaagacacagggtctgggttggaaggttcaaagggggtcttgcaggatgtagaactagttggaattggagtttttggacattatgaatgcattttttaaaaatatggatgaaaggctgggcgaagtggctcatgcctgtaatcccagcactttgggaggccaaggtgggtggatcatgaggtcaggagatggagactatcctggctaacatggtgaaaccccatctctattgaaaatacaaaaaattagctgggcacggtggcacatgcctgtaatcccagctactcaggaggcggaggcaggagaatcgcttgaacccaggaggcggaggttgcagtgagctgagatcgcgccactgcactccagcctgggcgacagagtgagactccatctgaaaagaaaaaaaacagatgaaaatgtatagaattatgaccaaaatatttaactaataacttagttattattatgatattcacaaggtaatttcaatatattaattttctctgtcttaaattcaatattcgaagataattagctgttaacaaataacctgcagcctgacgaatatggtgaaatctcatctctataagaatacaaaaattagccagctgtgttggtgggcacctgtaatcccagctacttgggaggctgaggcaggagaatcctttgaactctggagttggaggttgcagtgagccaagatcatgccattgcactccagtctgggcaacagaaaaataaataagtaagtaaataaataaatagatagataaaacttggaaagccctcactacatgggtacattaggaattcctgcactttggagaaagaatgctgataatggtttaacaacgttctctgatttttcagtttgctaccctcgttttttgctattattgttggtctaggtcagggtttgtcagcctcagcactactatgttttgagctgaatgattctttgtgcgtcaggctgcgctgtccatcgcaggatatactgcagcatcactggcctctattcaccagattccggtggcacggctcttctggtgacaactaaaaaattgctccagacatggtctagcttattataaacaattttatttttatgttgtgggttgtatagcaatgtttgatccaaagtatttatcttagcttgaaatttgcagtagctagacatggagatgtctattactgggttttgaacattaattatacatttattgctaaatcatctcacatttccctttatgagtcatcatcatattttcttaaaaaattaggtaagggtttgagagccattgctctgaattcttttttttatttttatttttttgagacagaatcttgctctgttgccaggctggggtgcagtgcagtggtgcaatctcagctcactgcaacctctacctctactgaatcgcttgggttcaagcgattcccctgcctcagcctctcaagtagctgggactacaggggtgcaccacaacctctggctaacattttgtatcttagtagagacagggtttcaccatgttggccacgatggtctcgatctccggacctcgtgatctgccggcctcagcctcccatagtgctgggattacaggcgtgaggcatcgcgctcggtctgctctgaattcttcatcccagtgtttcaaataattgtctcacttccagctcacttatctgacctgaccctgacttttccaatagagccatttcccccaattctccatgtgattcagcaacaagatgtattgtgacttttccaagtgtatatctttaccagaatatacttattcacatcttttttttttttttttttgagacagagtctcactctgttgcctaggctggagtgcagtggtgtgatctcagctcactgcaagctccgcctcttgggttcacgccattctcctgccttagcctcccaagtagctgggactacaggcgcccgccaccatgcccggctaagtttttgtatttttattagagacggggtttcaccatgttagccaggatggtctcaacctcctgacctcatgatccgcatgcctcggcctcccaaaatgcagggattacaggattgagccaccgcgcccggccttattcacatcttttaaaagcacattttgagaattcgaaatggtcaaaaatgtctccccaaaagataggtaagcaagatcctacatcttccttgactcccatgagtcaacagaggcaattttctgacatttgcctttcgttccttcctcctctgcccatcctaaagaacttggcctccatgagccagagcccacctacagagggctgtgtacatgatatgctgcttctattttctgtgggaactgacttgcattttgagaacatttgagtaaaactggaccaccgttccacctagtcatgctcattacaactgatccctgtgcgacaggagtcaaggcggagcttgctttttgatctgatgaccgtctcaatttaattccttctccttgtcactagatatgtaacagcaatgtcactttagaaaaaacaaatcagctctctgagcatcagtttccacatgagtaaaaagattaatgcacactcataggttgttaaaaacattaaaggagataaagcatgatagaacttaaacataaaagtccctatgtagatacttattttctcagcattatacaaccatccctgagcaaggatgtaagagaaggcatttgcctgtagaccaccaaacagagaaagaagagggtgaacaccaggcatcatcggtattacttacctgattcaaaccattacctgtcgggcttcttctaataaatcaaattgttcctatcagaaagagaggtaggccgggtgtggtggctcacacctgtaattccagcactttgggaggctgaggctggtggatctcttgaggtcaggagctcgagaccatcctggccaacatggtgaaaccccgcctctactaaaaatacaaaaattagctgggcgtggtggtgggcacctgtaatcctagctactcgggaggctgaggcaggagaactgcttgaacccggggaggttgtgatgagccaagatcgagccactgtactccagcctgggcgacaagagcgaaatttcgtctcaaaaaaaagaaaaagaaaagaaaatttaaaaatattcacattttccacaactccttcttatccacataaaatatctatataaattattattctctatttggaataaaacactttaggaagtcctgatactcactgtcagtaatggacacctgttccgcatggtggcatgctcatatctaaagtcccgctttcattcctgattatacctgattctgcaaatgttttcagaaatacatcaagttcctaacctagttctaaggaccccagactgtatttcttctctaattccccaagcttacgatgcatatgcattttttctcattagcataggatctccccgttattatcattcatgattcaggttaagtgcaacctcttccactacacacaggtgttgacagttacacaaatgcaaaggctctggatattaaatcaggctcctactcctggaacgctttttattgggttagtttacacaaattctttcaaagtcttgttctccaactttctggtgtctcgtggtcttggattttacacacagaagattaagggctaacagtagcatcacaagaaggaccatgttgtaagatggtgagggagtctggacttgtgtctccatttgggatacagagggaaaacacaggcctgagagctccttggaaggcgcaatgggagaaattgtaaatgagggacatctcggtcacattgtagaatgatatctgcccgtgttcgcagtcaaggaaaacgccaactgtgtccaacttcttttccaggaagagccttttcagaggggggaagacccagagagtccactcggtccccatcaccgaccccgtgagcaagactttctctccggaagctctggccgtgctgcccttcgcgtctgcagagccgtggtatatgcccacttgccacctggttgccttttccacgtccacctcccagtagtgcctccctgaggtgaagctctccgcagccagcaccatggcactgaaatccaatctttctgggttgccagccccatcctgctgcccatgtctcaatctcatagttctcaggtcctcagatagtgccaggcagggatgagctgtttcaggatccaatgttaaatgtcctatcaggagagaaaaccctcgttaacctaggagttcaccaatgccaatgccagagacatgatttctaacacacctgggcttcccactgagtgggcacaagtcccaggcccagatacgggagaggcaatttgggagggtccaggaaaaggaactgctgaacttcaatatggacctcatggaggaaaaagtccataagatatggaaagggacacagtctacctgagcgggaagaataaaacaaagatgaatgagctaaggaaggtttagaaacaccttcatccaacgtggcgcggtggctcacgaggtcaggagttcaagaccagcctggtcaagatggtgaaaccccatctctactaaaaaaatacaaaaagtagccgagtgtggtggcaggcgcctgtaatcccagctactcatgaggctgaggcagaaaattgcttgaacccaggaggcggagattgcagtgagccgagatcacaccactgcactccagcctgggcgacagagcaagactccatctcaaaacaaacaaacaaacaaacaaacaaacaaaaaacagcttcaccccagagacggtcaaactgtcctggtgccaagttccatccagatatcacttggggcccaaccctggtcttctagatctccaagcctggagcggccacaggagtcggccagcagcaactcattcgtggccctcccgatgccgtactctacacatcttaaatatccccacagggtgacatagaggcctggaaattgctgacaacaggccctggacatcaggcattacatcagataatttatcagcggaggatggaacacctgtgtggaccctccagaaactcacgctgagaacacgcaggctcaatgaattcctcacacctgcatgaatacgtcttcttcctatctctgactgttcctctcatctctttctgcccagcctctaactattgtgatctttcagggcttggtcctgggacttcttctttcaagtagtatattctccttcactgcccccaggtaactgtgcatagcttcagttttaaacatcttctctgtgtttgtgactcgctccataaacagctaaataccagttggaaaaaacacaggaatttcaaacataacacacccaaaatggaacttcaacgccagccctctgcagtctctacttctcagttcacagctccctcattgcttcagttgtctaagccataaacctggaaggcctttatttcctactttctgtaatgtggaatccagcttaatttctattatttgactgaagtaaatttaatgaacttaaatctctgaatttgaagcccaattcacattattagggtggtctcaacagctacacgtcttgaatttttaaaaaattgtctgagactctcagtatttccaggagactggcagaaacaaatgcaaattatctctggaaaaacgcacagctgtggctgggcacggtggctcacgcttgtaatcccagcattttaggaggccgaggaggacggatcacttgaggccaggactttgagaccagcctggcgaaaccccatctctactaaaattacaaaaatcagccaggcctggtggcggcctgtaatcccagctactcaggagggtgaggcaggagcatcgcttgcatctgggaggcagaggttgcagtgagccgagatcatgccactgccctccagcctgagcaacagagcgaggctcatctcaaaaacaaaaacaaaaaaggttgaagaaacaacaggagtatctcaagagaaaaagaacttgataaattcaacattgattcataaaaattcttagtaaaccagaaataaagggggacatcctcaatttgatgaaaggcagccattaaaaaaaactatagctagggccaggtgcggtggctcacgcctttaatcccagcactttgggaacctgaggcaggcagatcacgaggttgggagttcgagaccagcctgaccaacagagtgaaaccccgtatctactaaaaatacaaaaattagctgagtgtggtggcactcagctactcgggaggttgaggcaggagaatcgtttgaatctgggaggaggaggttgcggtgagctgaggcttcgccattgcactccagcctgggtgacagagccagacagcatctcaaaaaacaaaaacaaaaacaaaaacaaaaacaaaaacaaaaaacacaaaacaacaacaaaaagcgctatagctgtatcagaatttagagtgaaaagacttaatgttttctttcttcctaagatcgagaataagcaagtgtccactctcaccacttctgttcaacacactgcaggtctgagccagtataataaggcaagaaaaattcagaaaaggcttacagactggaaaggcagaaataaagctatctatactcatatactgcatgactttgtagaaaatcctgaaggatctatttatagaaatccactgtctaatgagtgagttttgcatagttatagggtacaaatgtcaatatatataaaacaattccatttctatatacttgcaatgaactagaaatgaatgaaatgtcaattagaaattgatattttaaaataccgtttacagtggctgtaaaaaacataaaatacttagggatacatctccaaatacatataacattttatgctgaaagtgacaaaacactgatgagagaaatcgaagacctaaataaatggagatattttgtattcctggactgaaagcaccaaatattgtcaagatgtcaattctccccaaactgatcaacggattcaatgtaatatgaataaaaatcccagcggtccattttgaagaagccaacaagctgatttcaaaatttatgtggaaaagcaaacaacctacagtagccaaaactattctgaaaaagaataaatttggagaatgcacagtacctgctttcaagacttcctacagagttatcaatcaagccagtgtgctattggcaaagggaaagagtcaaccatcaatagacctattagagtcacaaatagacgtgatcgcatataccagttgattttcaacaaaggggccaagtaaattgaatggacaaaggtagtgtttttaacaaatgaaactggaacaaatggatacatgtgagtcaaaaaataaaaatagaaggtggggggaggagagggtttgcaccattctgtgaactgtatacagatattaactctcagtggttcataggccacaatgtaaaaccgaaaaccataaaacttttggaaggaaatctttgttggctttggcaaaatttcttaaataagacacaaaaagcagaagtcataaaagaaaaaacttgataaattgaacttcatcaaaatgcaaaacctctacacttcaaaagacagtattaggaaaatgagaatacaaaccatgctgggaggaaatatttgcaaaatttatctgataaatgaatgctaaacagaacatataaagaaattataaaactcaagagacatacaacccaatttagaaaaggggtttgtacatgtatttcaccaaagttgagatagagggaaaacaaacacatgaaaatatgctcagcatcattagtcattctggaaatgcaaattaaaatgacataccactacccatctatcgggtcggatgtagtaaaacaaactgacaataccaaaccctggtgagaatacagagtaactgaatctttcgcacgttattggtgggaaggcaaaatggcacaggcaatttggaaaacaagtttggcaatcccacccttagacagtcaatcaagaactatgaagctgtgcccacacaaaaatctgctgctaatatttacagcacagagctggaaacaacccatgtccgtagaattgcaaaaggataagtaaattatggtatatttatacaatggaatattatcaacaataaaaaggaacaaactactgatacacgaagcagcctggacgttctatatgtcaactgcagtatgctgtcagcctcgaaaggccacacactgtaggattccatcgataggacattctgggaaaggcaaagctataaggacaggagatataaaccctttgttatacatgctgaatttcttccccagaagttttaaatttttaagcagtggaatctgcctgcaatcatgtttcatggctggggaactggtaaagaatctgcagccaggcgtggtggctcacgcctgtaatcccagcactttgggagcctgaggcgcgtggatcacctgagatcaggagttcaagaccagcctgaccaacatggtaagacctcgtctctaccataaatacaaaaaattagccaggcgtggtggctcacgcctataatcccagcactttgggagcccaaggcgcgtggatcacctgagatcaggagttcaagaccatcctgaccaacatggtaagacctcatctctactatacaaaaaattagccaggtgtggtggtgcatgcctgtaatcccagctacttgggaggccgaggcaggagaatcacttgaacccaggagggggaggttgcagtgagccaagatcgcaccactgcactccagcctgggcaaagtgaaactctgtctcaaaaaaaaaaaaaaaaaaaaaaaaaaaaaagattttgcatgggaagagctttcatatgagatcatacagttatttttttgatccttatctaatatgtataacatattaagctctccagtctcctaaaatttttatttatttattttaagacagagtctcattctgttgcccaggctggggtgcagtggtgtgatctcagctcactgcaatctccacctcctgggttcaagcaattctcccacctcagccactcaagtagcagggactacaggcacacgccaccacaactggctaattttcgtattttttgtagagatgggatttcaccatgttggttaggctggtctcgaactcctggcctcaagcaaaccgcccgccttggcctcccaaagtgctgggattacaggagtgacccactgtgctggcctaaaattgttaaactactggaatttgttttcatttatggcaggatggtcacctgattctcaaatgcagaacagtgccctgtgagtattcacatgtgtcaacttactctggagtactctgaacatgctgctgagtcctcttatgtggcataaactcaggtctgtgatatgagcgggctccagatgctcaagcagcagtgacttgctcctgaagagaaaggacagcctcagtcatctgcacagaccacaggccccttagtctactggatggatcccattacatcctaccagcaaatgcaatctccctatctcaatcaacatcttactggactctgattctcacccaattgtatccaaaatgaaaactcacctttctaaagagtattttgcattctaagggaaagaaaagagaccaggttactactgggtttttgagctgtttttgcaatctgtgcccaggaaaatatcctcttacaatgaactcaatttccatgtcatttcttcaacctcataatgctagttatcagatgaacaaattctaacatggaaacagaaaaagtcagaaaaatgcatgaaatcattttgtcgtagtcccaagggaaaggttttctatccctcaccccaggcatcttactcagagccatcatttctcagtcttcagacgggagcatctatctgctttccatgcagggggtggccagagttcagcaggtgaaggggccactggctgggagggcagtgggagccaggcagagccacacctgcctgcatgctcaagaactgagctgcttcctaaggatttacctacagacgctttccagatgagcgcattcattgcaattataagcccaggagagggatatggacagtcttaaaaagatagtaaggccaggcgcggtggctcatgcctgtaatcccagcactttgggaggccaaggtgggcgtataacctgaggtcgggagtttaagaccagactgaccaacatggtgaaaccccgtttctactaaaaatacaaaaattagctggacatggtggtgggcgcctgtaatcccaactactcaggaggctgaggcaggagaatcgcttgaactggggaggcggaggttacagtgagccgaaattgcgccactgctccagcctgggagatagagcgagactccgtctcggggaaaaaaaaaaaaaaaaaggtaacccactttctgaaaggcaacgtatgttactatacaaaattcaaaatatgcaatacttaccatagactgagtagcttctgcacagcagaaattcatttctcgcagttctggaggccgaatttcaagatcaaggcactggcagattcagtgtccggtgagggctccatccctcctaggtagcctccatctccagcctcacaagctgaaggggtgaggtcttcctcggcctcttttataagagccctaatcccattcacaggggctctgcccccaggccccactcactacccaaaggccccacctcccaataccatcgccttgggggagaggatttcaacatatatattttggagggacacaaacattcagatcatagcagataatctcacccttgtttcaagattatcacagatgactatacatttattaattttttgccagaaagtctgtgaatgttagcaaccacacatgtatatgtgtgtgtatatatacttattatccaaagatcaaacaaaaagcagtctgcatctttctttttcacttaatgagtgcttgaaatactgttagtgcctatagagctgttttattctttatgatcacagaatatttcattgcatggaggtattaaccacattgtgtcacatctcaaccctaacttactgctgataattttaaggtgagaattcatctcatgaagcagctccacactatcccacaaagctatgaccattcctaaagcttttggcagctgaaagaaagtcatgtagccttcttttgtggttgaagatcattggatattgtgttctgacagcaacccctaatgagtactgtccacttctcatttctcaaatactggaatgaattttattttctttttcccagcatcttaccttgagcaatgccaaggtgccttccccacactttttctcaagctccacgatgagctttaggaggctgcggacctgttcagaagccctggcttcactctccttcagtttctccatgttctctctccccacacggcccagtctctgcagaagcatttcttcgttactattcaacaacctcaagttcaggaacaagagttcggtaacttctcctatagattaattcaaccatgtttttaaaaacctgcttttcggttgggcgcagtggctcacgcctgtaatcccagcactttgggtggccaaggccggcggatcatgaggtcagggtttgagaccagcctggccaacatggtgaaacccagtctccactagaagtacaaaaattagccaggcgtggtggcgggtgcctgtaatcccagctactcaggaggctgaggcaggagaatcgcttgaacctgggaggcagacgttgcagtgagccaagatcgtgccactgcactccagcctgaatgacagagcaagactccaaatcaaaaaaaaaaaccaaaaccaaaaccaaaaaaaaaaaaaccctgcttttctgcctgctaccccaggaacagacataattaggcaaggccatgatattcttctgctgaagcaggattcctctcaagagacagttgattctttgccccctgttatgtatgtttaagccaatacagatgtgtgtgcacgcagcccttactcacattaatatgcacctaaaacatttcatgttttttctgtggctgtttgttcagaaggttccctattttttcattaacttgaaatcaattaaaattaaggtatatagattaactaataagaaataaataattacgttactgatatcaattttctttttatccttccaagtatactttacatatactgcgtagtcacatacgcaacttgagtatgttatttagggggaaaaaacataaacataagtgatagtttattatatttgattactaatctgacaacttactttattcttggagaacattccttattcatatacacagagccatgacatcatcttaacatgctgaagagtattcttccatgtatgtatggagcacattttgtgagtcttctattgacaaatacagggtgtttctaacctcttgctatgaatgttataattgtaacatctgctactcatcaactgcttaacatgaacaagacacgatttaataagctttagcagattatctcactcaaatctcacaataattttataaattaggggtcactgttatatccagtttacagctaaaggaaccaagtcaaaggttaagcagcaggtcgtaggccacccaggagccagtaaacagctggctcagataggaactccattcatccggcttcaaaggtgaattctaggccgggcgcggtggctcacgcctgtaatcccagcactttgggaggctgaggcgggtggatcatgaggtcaggagatcgagaccatcctggctaacacggtgaaaccccgtctctactaaatatacaaaaaattagccgggcgtagtggcgggcacctgtaatcccagctacttgggaggctgaggcaggagaatggcgtgaacccgggaggcgaagcttgcagtgagctgagattgcgccactgcactccagcctggagacagagccagactctgtctcaaaaaaaagaaaggtgaattctaaaccatggctctaaactgaaactcagtttcagtgttgccttacccaggtgtctttttctatgtgtgtaagtatgtttgaagcataatacagtaatatgtgtacaaatatatttataggtatattgtgctttatttatgtctttttatatgcatgtcaagataaattcatagaaatggagttgccaggtaggtatataattcatttaatacatgtgtggttgtcactggctatgttattttggaattgacataatgtttagctcttctttttctcatttctcaaatatgaggatgttgttttcaatatctcacctgtagcatttcctggaacatctcctctagctcggtggcaagcttgatcgcttgattcagaagggtttctctcaggttcaagtcagatatgcattcctgctgtctctggagattctgctcacactcttcattcaacaaccggagtctcatactatactcagactcaatcatctttttaaaattttgttcctcttccttcctcatatagacatgatagacttcaggttaaacatgatagattaacaacacacacacacgtcataatagatagatatctatatctatatatagatatatatatcttacactgaccacaatgtattctttccatctctaaccccaatataaagacaaggaaggctgggcgcagtggctcacgcctgcaatcccagcactttgggaggccaaagtgggtggatcacgaggtcaggagatcgagaccatactggccagcatggtgaaaccccatctctactaaaaatacaaaaattagctgggcgtggtggggagcacccataatcccagctactcggaaggctaaggcaggagaatcgcttgaacctgggaggtggaggttgcagtgagcagagattacgccactgcactccagcctggcaacagagctagactctgtctcaaaaaaacaaacaaacaaaaaaagacgaggaaatgtaaagtacagaagaaaaggaataaacccaaaggagaaatagaatttgagtcaacatcagccaagacatcaacacaattttagaacataaaatgcagacgaagaaatgttcatcaatgaattggctgggcgcggtggttcacgcctgtaatcccagcactttgggaggccgaggcaggcggatcacgaggtcaggagatcgagaccatcctggctaacacggtgaaaccccgtctctactaaaaatacaaaaaattagccgggcttggtggcgggcgcctgtagtcccagctactcgggaggctgaggcaggagaatggcgtgaacccgggaggtggagcttgcagtgagccgagatggcgccaccgcactccagcctgggcgacagagggagactccatcttaaaaaaaaaaaaaaaaaaaagaaatgttcatcaataaggaaaaactaaggaagctatagcctctgtcaaacagaggaggagaccaggacattggaaaagggccaatgggatttgctgatgcttgggtaagagttgtggggaaaaaaggagtcatggacgaaagacaccaaaaattttagactaagcaactggaagaatggaattaccaaaatatatagagagaatctatggaaaggctggattccagaagtgaggagtgtgcgttagctcgggatgtgatgaatttgattagtcaattagacatccaagtaaagatagtaagtaggaaattggacatgaagcctactaccatttggaaatctgagctagggatatatatttgaaagtagtcatcttagagatgcttaaatagcatctctattaagctatttaagattcagtgaaattgtccgggctcacgtctgtaatcccagcactttgggaggccaaggcaggtggatcatggggtcagcagttcgagaccagcctgaccaacatggtgaaaccccgtctctactaaaaataaaaaaattagccaggcatgatgacgggcccctgtaatgtcagctacctgggagactaaggcaggagaattgcttgaacccgggaggcggaggttgcagtgagccgagatcgcgtcactgaactctagcctgggtaacaagaacgaaacttcatctcaaaaaaaaaaaaaaaaagattcaatgaaatcaagatttatcaagaacctgactacttctcaccactgctctacctgtcccccagctcaccatcatctctccctaattattgcaagtccctttgcacgtctctccacctctgcttttactctcttggtttttttttttttttttttttttttgagacggagtctcgctctgtcgcccaggctggagtgcagtggcgccatctcggctcactgcaagctccgcctccaaagttcatgccattctcctgcctcagtcacctgagtagctgggactacaggcacctgccaccacacccgattttttagtagagacggggtttcaccgtgttagccaggatggtctcgatctcctgacctcgtgatccgcccgcctcggcctcccaaagtgctgggattacaggcatgagccaccacgaccagcctgcttttactatcttaatgtctattttcatttggcagctagcgtgtttctatgaaaatggaagttaaatcatgtcagccttctgttcgaaaccttccagtggttttgaagcttgtatttcattgaaggctgccaccctaaatgactgaccgccttcttctgatctcatcacctacagcccccgtttccttacacagctccagccacatacacggcagcctccaggcctttcctctgcctagaatattcctccccaagaaaactgcatggcccaatcccccacctccttcagtgccaccttctgaataacaaggttctgatcactttatttacaagctcactccattgcttcctttctcacttaaaaaaaatttttttaaacacttcccaggtaacatactatatattaaacttattttgtttatatccactagaatgcaagttccacgaaagcagagctggttttttttgttttccattggtgagcccctagcaccttgcatagtccctggcaaacagtgggatctcagtatttgctgaacacatggtacttggaactgaaaaagaagggggatcggttgaaaaatccttacctagccaggcaattctcctccactatcttccctaagtaggcatttatttcctttaaaaattgagggagagaaaagacccagaatcggggataccttgcacagaataggattaagtatgaagatacaggctgaaattagaagtgaaatatgcctaacaggtggtgaaccctcaaatctgaatagctattctcaaattgctctttaaagggttttagaatttatgtggcaaccagaagtacaagagatgctcattctcctatgtcattgttataaacggtgtcgttaatctttttgatcattgcaaatagcattgcaaatgccattttactcaccatataatttgtatttctcttaccacgaacaaagttcaaattctttcaatgtatttaaaatatatttactttcttttctgcaaactcttatttgatcgttttttaaaattaaatttctagtcttttccttactgactttttttatttttattttttttgagatggagtcttgctctgtggcctaggctggagtccagtagtgtgatctcggctcactgcaacctctgcctcccagttcaagcgattctcctgcctcagcctcccgagtagctgggattacaggctcgtgcaaccacacccagctaatttttgtatttttagtagagatggggtttcaccatgttggccaggctggtctcaaactcctgacctcaagtgatccgccctcctcagcttcccaaagtgctgggattacaggcgtgagccaccacacccagcttcttactgactttaaagagctttttatacattaagatattagcacttttccttcctatagatttcacatttttcctgctttgtgatttgtcttttgactttgtttatgatacactattttctaacaacattactggtaatttccccccaagaatcaagataagcactcactgacctgaatcatcgccattctttcttgctcatcagtcaatatgcttttagctgcttcaagtttctccctcgatgtgttcaatatttcctggaataacttctatagagaaagcacagaattccaggtgagatcattgatttagaacagttggattcctgaccttaaacagccaacaactctgagtatatattttcttagcctttaggttgaaggttcaacgaacttatctaatattctgtaataaacatcaactaaggtaatggttttggaggaccagaatgtctgtccatttcatccatataggagttggccagagtgttttgggatttgcgtgagtgactcttaccctgtaattctcagcagcctcttgtatcccacacaccatgtgatgtttgtgctcctgggactggaagcatttgctgcagagtgtgatttggtcaacatcacagaacagccgtgttggttccaggtgtgtttcacaataggcatcttctgtgatgttgtgctgtaactgagggctgagccttttggacatcctggtaggggtccctagttgaagactggactgtatgcttctactgaggtatctccctgcactgtgaatgagaaaaaatggtggcttcctttgttttctggagcaggcacacacacttggcaacttcagagtccacgaagatccaaggaaataagtccacgcagacagagcgggtcggcgctctggactcctcaaatccaacaaatttctggcagctgcctgcttggggaaaagacagagttaggccagtgttctaagaccagcgggtttccctcaggtcttctgacaatcttgagcaataggctgaaaattaattacaaggaacagcactcacttacgagtcattcaggggaaaacagtgctctaaaggcatcgcgctaattactgaaggaacttcaggactagagtgaggtaacagagtgcgaaagaggttcgttgatagaattacagaaaaaaaccacaagtatctgaaaaagttattaaaatactttccctttgagagacagggtcttgctctgttgcccagtctagagtacagtggcgtgaccacggctcactgcagcctctggaactcccaggctccagcgatcctcccacctcagcttccggagtagctgggactacagctgggacaaaacacatgcaacagaaggaatggggaagcaaataagggaaaacagctcctctttttttttttttgagacggagtctcgctctgtcacccaggctggagtgcggtggcgcgatctcggctccctgcaagctccgcctcccgggttcccgccattctcctgcctcagcctcccgagtagctgggacttcaggcgcccgccacctcgcccggctaattttttgtatttttgtagtagagacggggtttcaccgtgttagccaggatggtctcgatctcctgacctcgtgatccacccgcctcggcctcccaaagtgctgggattccaggcgtgagccaccgcgcccggccgaaaacggctcttctaagaagccatcaattaaagagatttgcaaaacagtgaagccaaagccactcttctcaataattgtttccgaaataaaatttcaggagtgacgtgacgcgctgcccgcggtctggccgtgagcgccctcgctccttcctctttgactccatcttcgcgggggcggcagccggaaccgcggttcagtcaccaacatgcagttcttggtccgcgccccggagctacacgccctccaggtgaccggccaggagacggtctcccaggtcgcggctcaggcagcgccactggagggcttcgccccggaagatctatcgtgctcctggcaggcgcgtccctgcagggcgaggccaccctggaccagggcgaagtgggaggccccgactgcccgggaggccaagtccgtggttccccggcccgcgctgggaaagtgacaggtcagactcttgctaaggtggccaagcgagaagacaggccgggctgagccgcgggtgcggtaccaccggcgctttgtcgacgttgtgcccatctttggcaagaagaagggccccaatgtccttcttaagtcctttgtaattctggctttctctattaaaaaagccacttagctcgaaaacttttttctcagaaaaatgtttttgtttttattattttattaacttatttatttatttttgagaccgaatctctgtcgcccaggctggagcacagtggcacgatctcagctcactgcaacctccgcctcccgggttcaaccgactctcctgcctcagcctcccgagtagctgggactacaggcgcgtgaaaccacacccagctaattttttgtatttttagtagagacggggtttcaccgtgttggccacactgatctggaactcctgacctcaggttatctgcccgcctcagcctcagtgctgggattacaggtgtgacccaccgtgcctggcttgtttttattattttaaatgaataactataaaatgcagttttaaatttctaatacagtaaacatagatattaacgctcataaacaaaagcttattgggatcttcgtcaataatgagtgcaaaggagtactgattccaaaaagttgagaatcttggcctgaaaaggcatattccccacaaataggactgtgaatgaatgcatccataattttgatatgttttgtcagtttcccaagcacaaaagttgtacaattttgcactccaagcaacaaattaaaaagatgttaaacttttggatcattgcccactggctgggtgagaaatagtgtattcatatattttcaacttccatctgttatattattaatatgtctaagccttttattttcatatgctaaaaaaccattttcacttcttttgctgtgaagtctatgttcaagcctctctctcagtttattccatcaggtttggcctttttggagggaggggtcaattttaagagagagctatagatccaagttcctgtaaattgtgtgagttgcaaatactttctccctccttccttgtttttgatgctctcatcctttcttctgcttaggtctttgaaatccctgctggtttcccgtgtcttaggtccctgaacatgtccgagatgactccactgagtcaccaaaacaaagaaattcaccaactcaaatttttccttgagctctcagcagcagttaacatagctgaccacacccttcttcctagaatgttttcttctctcatctgtctgcagctgacattcctctaacttgtctggtcttgttctccgtggccttttctggtcccacatcctctgaacctctcaatcttggggtgcttcaaggttgagttctggtctcccagtcctggtctctccctaggtaatcttactcgtttctgaagatttaagttccattctccgatttcaatctcctgcccaattcccaacatttttgcaatagaatgtctaaggagcactcaaaattaacatatctaaagccgctcaggatctcaacccagtggctctcttcccccaaactcattcctttagagccacagtttaagccttcctttcaccaattcaactattgttttccaaatttatattctgtcctgccctcctcgtccatctccagctcctctctgctcaaccaccagaatactattttaaaaccaaaaccaagtgagcaggtttgtggtcactttctatggcattagagtaagatcgaagtgggtaataaccccgtcctatacaatctggcctcctgccttcttctgatctctctatagctttcccccatcactgtcaatctagctgcctctaattcatcacagcccttcccccttccgtggccaacagagctcttctctcatatttttgcaattccagctgcctcttctttcttctcttcagttctcagctcaaatgtcttcccaagagagacctttccatcactactcaatttgaaataccttcccactactcatctccttattttattttcttagtagcgaaaagattttatctttctatgaacaagtttacttgtgggtcactctccatccataagaaactaagtccttgagatgccctgtgtctacatctgacatactcgatgcacaataaatattgtaaacgatattttatgttaaaccagtaaaaattgaaggtgtaatgagagagggacagagactaaatatttttacagaaacagcaaaggaaaattgacgaattaagtccccagcatgttgtctacccttattttgtttttcctaatatttttcttcaggctttttcctgataacacacagatacacacacacacacatagattctaagatcaagtttagaaatctaaagaaacaattattaagaaaatgatctatagagaaaatctcacttactttctttgtagcaatcctgggtatttccttttttttttttttttttttttttgagacagggtcttgctctgtcacccaggctggaatgcagtggcgcaatctcggctcactacagcctcgagctcccaggctcaagtgattctcccaccttgacctcctgagtagctgggattacaggcgctgcacgaccacacccggctaatttttgtattttttgtagagacggggtttcagtatttttcccaggctggtcttgaactcctgggctcaagcaatctgcctgcttcagcctcccaaagtactgggattacaggaatgagtcaccacaccgaaccaaggtatttcctttagggaaaaagctggaacagtggagactgaagagattttatctgttcaattcctccctcagccccgccctcacaccatcaggaaggcgtctgtgaagtttcttatcatattcacacaattaatctcattagaaccacctgagtttattaaaacgcaagcctcttcacagggtctctgattccagaaatctacggtggggtccgtaatttacatttttaatggactcccagaaaatgcttaatagccctgaccttggttggataaatatcttgttttatctccagtgccatgtacagtgcctaacacctctagctccttaaggtttggggttttctttcttaatgaatctagtgtatattgacaatttcacaggaaagaagccttcgagctaacactcaagactgtgtttgttccttagtagaaaataatgcctgacttgttagtttctagaacgtttgctggagaagtgttcattccagtatctgtggaaagaaaaaccaagagtagggataactgcctatggaatctgtcacagatgggaggtcagggaacaatcccagataattcatacttgatatttggcttcagtgaggaggaactcttcacagctttctaagttttatagttttgtccccgagggtttttattgcatcagtcagtcaatcccctgctaatcaaaccagggagtttttttctttatgctgctgacaggataatgagaattcttctgctttgcttatctgatctttcagaacctggttctaccttatggaatctcaatacaccgtttctctttttcttttttctttctttttttttttttttagatgagagtctcactctgttgcctaggctggagtgcggtggagcgatctcggctcactgcagcctccgcctcccaggttcaagcaattttcccacttcagcctcccgagtagctgggattataggcgcccaccacacccagctaatttttgtatttttagtggagatggggtttcaccatgttggccaggctggtctcaaactcctgacctcaggtgacccaccctccttggcctccaaaagttctggccaccgcgcctggccatacaccctttctcttatctcagatgattacctacacccactctcttttccaaaacccaattccccagctttcttcaaatagaccacatttattcctgtgccccctcccctcctcagccagtccatcctcctttacttctcttatttttctaatccaatcttcctttctcttctaagcctgggtacggccaacgtctgtgaagatactcacacatacttgttgtcagatactctgtcatttactctcaccatcccttgagctttcataactcttgagcttactcatcttgacaagaaaactttgtaatctttgaatcaaatggaaaataaacatcaagcatattgtcaggttttgaagtctcttaaagcctgttttagagtattaaatgcttaaataaatacttattaaagcctgttttactattaaataaatatttattaataattaaattattaattctagaagagtcaatattttaagataattctaaaaacattacaaaaaagtgtgctaaacccttatttactgttacatgccccacctgttgcatgctccaaccccgtgaggtacatctgcagctgatgaagtagatgacgtagagattaagtcacgggattaagtaattgaccaagagcactgggtgcagaaaattgaagatatggaatttgaatcgggtgccaaatttcatgatatttccttattataattatttgtccttattaaatattaatcaaatggcttgacaatttacaaaaaagatgcctcaaatttgtatgacaatttatcacgagatgctttcatagggctagagtaatcacattacaaggaacacagatcattttaaggtagttagatttttcataggaaaacttttcattaaaatgaaaatcctgaagaaatgtagttttttttcactgtcaaagaacaaatacaattatgaatgagtgagtcattgttctcctgagtcatttcatgaacttataacagtcgtatcccagccgggcactctggctcatgcctgtatccccagcactttgggtgaccgaggcgggtggatcacttgaggtcaggagttcgagaccagcctggccaacatgggaaacctcatctctactaaaaatacaaaaattagccggaaattgcttgaacccaggaggcggaagctgtagtgagccaagatcgtgccactgcactccagcctgggcaacagagcaagactcggtctcaaaaaaccaggacaaaacaaaaacagtcctgtcccctttgttagccacatcaccttcaccactcgccccaggctggcatactctcggcttctgggtgggatgagtatggctggtgccaaacaaggctgtatttgttactttggaccaaatctgcggcaggagactaccacctcctcccattccagaaaagaacagctggaggcgggggtgtgctggttgtggtcccagtgttatcactcatctggaaggtgtggcttctctctggctccttttctccaaggctgctccattagaagcaggggcttggctctcactggtttacttcccacagctctaagaggtccagaagtcatgttcaactgcttcttccttgcttaagaaagcattaaaacttaagaatcaggccaggcgcagtggctcacgcctgtaatcccagcactttgagaagccgaggcaggcggatcacctgagttccggagttcgagaccagcctgatcaacatggagaaaccccgtctctactaaaaatacaaaattagccgggcgtgggcgcatgcccagctactcaggaggctgaggcaggagaatcacttgaacccaggaggtggaggttgcagtgagccgagatcgcgccactgcactccagcctgggcaacaagagcaaagctctgtctcaaaaaaaaaaaaaaaaaattaagagtcaaacattatgggggccgggcactgtggctcatgcctgtaatcccagcactttgggaggccgaggcagttggatcacaaggtcaagagatcaagaccatcctggccaacatggtgaaaccttgtctctactaaaaatataaaaattagctgggcatggtggcgggcacctgtaatcccagctacttgggaggctgaggcaggagaatcgtttgaacccggtaggcagaggttgcagtgagccgagatcacagccactgcactccagcctgggcgacagagcaagactctgtttcaaaaaaaaaaaaaaaaaagaatcaaacattatggtcgacctcatgatagcacagttacccatttgttgttgtaagtcagtgcatgcttatctgaacccaacatgttcagtttgcttgcactcttttgtaaggaagataatcctcctaacaattccagcagaattaagaggtcaccttcacctcacctattacaacaccgggacaagccctatcggttttcaccagacagaataccctcagcaaaaggaacgggctggtttaactgaaatcagtgaatcctgagcaaataaacttcggatttttgccaaagttcacaggctgaggaaagcatcatgtctcatggatgaagttagactgacgtgggctctgattccagcttggccacacacttgtcatgacctgcagcaagccactgaacgctgagcatcacttgcaccatgagtcaccgtcaccatcttccacaagtctctgagcattaggagaggttcgatgaaatacacgtaggagcgaggagggtggtaatgagaacagaaattgctctctgaatgagtatgcttcctctcctcacccagagtcattcttttcagcaaagtcaagagcacggccctctacataagggagagtgcagccgggaaggtgatggaggtggtagagatgaattattggcatatgggaaataaagagatctttgatgcccttttcagtttcttttgtttaataatatatatattagtaatgtagtaattgcgtaattgatatcaaggcatatattcagcttttattaatgtaatgtttatctgaaaacttttaggccactggtataatttttttttttttgatactgagtcttgctctgtcactcaggttggagtgcagtggcacgatctcagctcactgcaacctccgcctcctgggttcaagtgattctcccacctcagcctcccgagtagctgagactacaggtgtgtgccaccatgcccagctaatttttgtatttttaatagagacagggtttcaccatattggctaggattgtctcgatctcctgacctcgtgatcgacccaccttgtcctcccaaggtgctgggattacaggtgtgagccaccgtgcccggccactggtataaatttttaggaagaatttttttctgttccattatagtcagtttcaacaataaagcctcattgtcaagatattaaaatcgctgggcatggtggcgcccacctgtagttccagctacttgggaggctaaggtgggaggatctcaagccagagaggtcgaggctgcagtgagctatgattgtgcccctgcactccagcctgggtgacagagtgataccctgtccctaaaataaataagtaataaaaatgtaacaagatactaaaatctacatgctgctcactatcattggaggatatgcatctttacaccctcctgaaagaaggagtcaaaaagcctcctccacactttaaagttatgtgataatctggatacccttcaggacctggacctgtttaaaaagactggcatcaaatgttgtaagggattggatctcagagaaaaaagcagctttataaataaacttgaccagaagttattatgccggcaatattcgttcaaacagaaaatctggccaggcatggtggctcatacctgtaattccagcactttgggaggccaaggtgggcagatcgcctgaggtcaggagatcaagaccagcctggccaacatggtgaaagcctgtctctactaaaaatacaaaaaattagccgggtgtggtggcaggcacctgtagtcccagctactcaggaggctgaggcaggagaatggtgagaacctgggaggcagaggttgcagtgacccaagatcgagccactgcactccagcctaggggatagaacaagattctgcctccaaaaaagagaaaagcaaagaaaagaaaattttatgtcgtcaaaatatttttacaaaaccaggtgttagtcttgcagaacttaatgcagttgagttaatttattcaacctactcaatttagtacacagtagggttgtactactgtgaacatagtttcatagtctgattggaatgaatgaagaaagatggctgagagacaaaataaatcaataaatcagtactatccatcttctctcaaaatataatgcaggaaatccttctccaaatccaccttcaatagtagccctagtagtgatgtaaacaagagtatttcctcagcatactcagtccctttactaaactttacactacgtttcctggctgcgacggcttagcatggatccgttgatcagtattgtcggtgcaatcctggagagacactgcttttttgcttctcttgttaaagtggttaaagtgaatgttaagtagaaaaagggcgtggtttgctagggtgaaagcagcacagagatagaaaacatcagggccaccctgagtaatgcacatttaaatttaaccaggtaggatataaactatggattgcttcttagtcataaagtaccttatataaagaaaatggaggccaggcgcggtggctcatgcctgtaatcccagcactttgggaggccgaggtgggcagattgcctgagctcaggagtttgagaccagcctggccaacatagtgaaaccctgtctctactaaaaatacaaaaaattagctgggcgtggtggcgggtgcctgtaatcccagctactcgggagactgaggcaggagaatcacttgaacccgggaggcagaggttgcagtgagctgagatcgctccactccactccagcctgggcgacagagtgagactccatctcaaaaataaataaattaataaattaaaaaaaaaaaaagaaagaaaatggaaacagccaggcacggtggctcacgcctgaaatcccagcattttgggaggctgaggagggcggatcacctgaggcagggagttcaagaccagcctgaccaatatggagaaatcctggctctactaaaagcacaaaatttgctgggcttggtggtgcatgcctgtaatcccagctactcgggaggctgagacaggagaatcgcttcaacctgggaggtggaggttgcagtgagctgagatcgtgtcattgcactccagcctgggcaataagacaaaactctgtctcaaaaaaaaaaaaaaaaaaaaaaaagagaagaaaagaaaaaaagaaaatggatacaaacatgaagttatagaaaagtagtggagatcatgtagtaaagtaaaaagatcttatggatataactctttgggaaaagttataaacacaaatattttagtaaacattgtaagactaaactagctaatgcaaaagactgttttctaagattcggaagtttacacgggatacatctacctaggcctagtgtgctttctcaggttttgtttctttaaaaacttaataattctcttggtattatattctcaaaaaaattgtctgcaaatgattttagctgagcatccctcttgcaggtagaagaaggataaatctgacagaaacatccatgggctgtatgtagtaatcacagttcgtgtgtgtgcatgtgaataaaatatgtttctttcacattattaaatcgttttttcttttgaaatgaagtcttgctcttgtcccccaggctggagtgcaatggcgtgccctcggctcactgcaacctctgcctcccaggttcaagcgattctcctgcctcagcctcctgagtagctgggactacaggcgcccgccaccacgcccgctaattttttgtatttttagtagagacggggtttcaccatgttggccaggctggtctcgatctcctgacctcatgatccgcccacctcggcctcctaaggtgctgggattataggcgtgagccaccgcgcccggcccacattattaaatcttaatatttatatcatttccactagtgtagatgctaacttaaatgcttggtcttgatctctgatcattaccaagtcaatatatctaatacttaaaattaatgtttttccctctgttgctgaggctggagagcagtggcaccaacacggctgactgcggctttgacatcctgggttcaagcaatcctctcaccggagcctcctaagtagagacacacgccattgcacctggctattttttcacaaagttttttgtagagacagagtctggctttgtttctcaggctggtcgcaaactcctggcctcaagtaatcctccccgccaaagtactgggatcacaggcgtgagccacggcgctggccctgttagaacatagagctagctttgtcaatgctttttcatcagtagtaggtagaatgtagggactggttaaatgttacggtgattacaatcttgaaagaaagtaagtggtatcattactgccaaataacttcttctttagcctgtaactatttcagtgcgcattatgattgtaactagaaacaatggaggcaggagccaggcctacattttatctattattctatctgcttagtgcaaaagtccctgactcctaatccaggatttttttttctcagagggttaaaaatagttttctttttaaagatttgtggactgggcagacaattaatggtacagaatccccacgcatattgtgggaatgaaaaaaaagaagacaggatgcagagttctaatggcacaattggcaaacagagtaggaggcagtctctaatagcatcataaacgaaaacagcccccaaatacctaggaagagctcttccttgtctgtaacaagctttgtttgaggaactaatagtaaagaatgtggttacagaaaatacagtggtgtctgccaagcacctcggcaaatacaaatccacactggagaaagagacgactttgtcttccgagatacctgcctgactcctactgctcagccacgcttctctcccacacgcacccccagtaatgactccagaggtcaagttctgagttctcacgatggcaggagaatcagcctgtcaagacggtcacctcgattaaccacacactgcaaatctgaggactccgtgagggaagggctctgttcctatccagggtttaggcactgggattagagttctccagaaagacacaatcagtaggataggtagagagatgcatgagaggaggtgtattaggggaactggcttatgctattaggaggctgataagtcccaggatgcgacacaccctggtgtgtcagctggagggtgtgtctccagccggagaccagccacgtgtgaaggccttagagccagggaggccgatggtggggctcgtggccagggctgaagccctgcaaaccccggctgctgctggtgtaagtcctggggcccaaaggcctgggaaccccgagttctggtgaacaaggacaggagaggaagagggcctgcatcccaccacagaagatggacacacagattcagtgcccacccgattgagggtagatcttccccatcccctccagtgtgactctcaccctcatcttttccagaaacactttcacagacacaccccaaataatgctttcccaggtttctaggcattccttaattcagccaagttgacacctaaaatcagtcgtcacaatgcgggggaaaaaagcatagcccccaccacagcaatgtatagacatgtcattatgttctcgccaacaggttctaccacaaagtttttgtgccactttgtagagtcctttttttcttttttcttttttttaagacagcgtccaggctggagtgcagtggcatgatcttggctgactgcaacctccacctcccaggttcaagcggttctcctgcctcagcctcccaagtagttgggctaaaggcgcctgccaccatgcccggctaattttttgtatttttagtagagacagggtttcaccatgttgggcaggctggtctcaaactcctgacctcagggatccacttgccttagcctcccagagtgctgggtttactacaggcgtgagccaccacgcctggtcactctgtagagtctcaaagagagagggtgtacccttctcctcttgagcctggcttcaatgtaaacataatgatagaaactgggtcatcagatatcctgtaggacggaggctgtatgtgtcgaagaaacgagagtcgaggtccctgaattcattctgcctactgggtattaaatgaggaaaataaacttccacccgttttaagccactgttactttgctttttactgtcacacatagctgaagctagtacattggatacattgactgtcctaaagttaagatctggaagatctaacatggacagctgagcatgggatttatttgagtttgggataactcatgggatcattctgagttttttggcagtgatggcgaggggaggtggcttaggaacaggagataaagctatggaaaaagcagtgttaatcgtggaggaggactcagactgtctctgccttctagactatgtggctttaataatgaagagctgcaacataaaacctgcgaaccaaaagcattttcttgaaactgatagttcctgaaaagagagaggatagaaggaaaccgctatttctatctaagtcctgtgtcccatggacagtttcatttgattttaatcctgtatgggtaagccttggtcttttcccttgactgctccaagcttggaggtgcagtacagtgatagaacagccgtgaatccaggccagctcgcctgcgccactgctgacttcgcctgaaaattctctcatccattcttaccatcttgctgcatgctcaggccttctcaaaaccaccttggggacgttcttcatcttggaatggtgcctgtgaacaaagatggagttattctgtttaggtaatgctaagaaaaaaatttgttttccttactcccttccctcactggatacctgcagtaagtaggccatcccttagacacaggcagatagagaagaggcactgtggtgggcagaaatatgagaatgcccccaggattctcacccactagtacacatacactttctcccagtttttcaaacacatactaatctgggtgctggccaggagcggtggctcatgtctgtaatcccagcactttgggaggccgaggcgggcggatcacaaggtcaagagatcaagaccaccctggccaacatggtgaaaccccgtctctactaacctccaaaaattagccaggcatagtggcgtgcacctataatcccaggtactcaggaggctgaggcaggagaatcgcttgaacctggaaggaggtggaggttgcagtgagccgaaatcacaccactgcactccagcctgggcaacagagtgacagagtgagactatctctcaaaaaaaaaaaaaaaaaaaaaaaatctggttgttgatgtgagggattttgcagatgtaattaaggccaaatcaattgaccttaaggtagggagactgccctggataggcctgacctactcctgtgagcccccaacaaagactgggtttttgtggtgaggaagacacaatgtgagggattggtggcttgggagaaggattctggagagacacacggcggggatctgacagtggcggacagtggcctctgacagcaactctcattgacagtcagcaagaaaatggggtcttcatccactcctgtaactttaaggaactgagttctgtcaacgatgtaaatgaacttggaagaagaccccaaacttaaaagaatacatgctgtccaacctctgagaccctgagcagagatcccagtcatgggatgctggatttctggcctgcagaactgtgagctcgtacatgggtgttgttttcagatgctaagtttgtggtcacccgttacaatgcaatagacaactgacgcagacactccactgaactgctcagtgactaaggagataaagaaagaggattagaagtggattcttcaagcaacgcctacatcttatgttgggttcaggaaacaaatcaagccgggcgtggtggctcacacttgtaatcccagcactttgggaggctgaggtgggtggatcacctgaggtcaggagttcgagaccagcctggtcaacatggtgaaaccctgtctctactaaaaatacaaaaattagctgggcatggtggcacatgcctgtaatctcagctattcgggagactgaggcaggagaattgcttgaacctgggaggtggaggttgcggtgagccaagatagcaccactgcactccatcctgggcgacagagtgagactgtatctaaaaaaaaaagaaaacaaatcaagaattctgttctaactcaaaattattttattagaccaaaatgatagcctcaacacaaacctagaatagctttgacacagaacttaacctagaaagaaaatatactcggtgaggattttttcatgagaaagtagtaaattttacccttcccctacaagggtgaaaccctctccctgaaccaaagttctttagaagatacaaagtatttgttttccaaaaattcaccctacttgtcactatacctgttcacacaagacaatgaactaaatgtcttcacatgttcagtgaaatgagcacaaattgctaccagtttcagtagttttacattttattttaagaattttcttattttaagaaaacgtggaatgcttcacgaatttgggtgtcatcctcgcacaggggccttgctaatctctgtatagttccaattttagtttatgtgctgctgaagcgatcatggtttccgtttttttctgaccagattctgcataagagaagcctcctgcaggtattgacagattcttgcattttctttgtttttctccacttcctactcattcacgagaggtttcacgtttgactactggtagttaactgtgtaatccacgtggttgaagttcgttccacgaagttagtggcgtacccgctctcagtcttacagaggctaacaacaggtagtcacagattgttacctgtggctttccactttaaggagataaatccttcttcaaaggaaatccgacacacagcacacacacacgtagttgaaattctcatccagccctttgtttatccagcatctgtttgttgctactctccatatatatgcacagaactgttagaatgcaatttgtggagaaaaataaaatacccacacacacacacacacacacagtcccctcctcttgggccagttattctagactgcaggttgctatgtcagttgaattaaccatgaccagtactaaaaaaaaatacgatatttgggccgggagtggtggcttacacctgtaatctcagcactttgggatgctgaggcgggcaggtcatttgaggtcaggagttcgaaaccagcctggccaacatggtgaaaccctgtctctactaaaaaatattaaaaaattagtcgggcatggtggcacgccccgtaatcccagctactcgggaggctgaagcaggagaatccttggagtgggaggtggaggttgcagtgagccgagattgcaccactgcactcagccaaggcaacagagtgagactccatctcaaaaaaaaagattcagggcactttttctgcagcaaagataaaagtgtttcatcagttgcatgtcccatgtcgtgtaaaactgtgtttcttccagtgggtcgtggtcaatagtatgaaaagcactgacataagggagttacagtctaaggcaagagacaaatggcaacactaaggcattgaaggagagataggaagaactatgagctcttgtatcagagggggaacttaattaaccaaggagacttggaaatgcttcccggaggaagctcaagctgagaagcaataagtggggtagatgccctttaccctgaggtatcttccattaatcctcgcagctcacttctaaaagtagtcatcgttgggcaaatagatgaacgaaagcttgctttcttcttcaaaatgattggtggtttaaaaggaaaactattaccgagtacaaaacaaataaattttttgtttcttctttttttttctttttcctttcttttaatttttttctttgtttcttcttatcatctagaagtgcctttggtctggtcctttcaaaatcttgagggttttgcaaaggttagcattttacatggaggttcccatggctctgtagcagatcttatatcataagtgaatttatataaaggttaggggagccacaagggcagtatttttatacgtagactatctggaaggtttgtatttataaagccaaaccccaaaataggttttcttaaacttttaagtttgtttagagttgttatataattctagtaaattttaccactcaaagacccttatgcttggtctcgtttacaaagctagaccattttatatagtgaggatatagttatcaatgaacgtagtcaatatttttaaatagtttaattgtctgacttgaaaaatatccttcctcagcaagaaattcttttttttttttttaatttgagatggagttttgctcttgttgcccaggctggagtgcagtgacgtgatctcagctcactgcaacctctgcctcctgggttcaagcgattctcctgcctcagcctcctgaggagctgggattacaggcacacgccaccatgccgagctaatttatgtatttttagtagacacagggtttcaccatgttggccaggctggtctcaaactcctgacctcaggtgacccacccgcctcagcctcccaaagtgctgggattacagacatgagccaccgcacccggcccaaaattcttatatgataaatcaaacttataaaaatagtgaacctgatattctgaaacatcacaatgctttgtatatatttaaacctcaacttagaatcacaaatctaaatcaatgactcaattatatgttttacattggagttacttggttatttccatagctgagttctcctaaatatcacaagcaaaactaaatagatttttacatatccaaaagtacgaagactctggttatggtacttctttcagttaaaaggcactagccttctagggaatcactgtcattgggttggacatttcagctgggcgtgaactctaaggcagcagatacccagggtgcttctcctcagcacccaccacggaactgacctcccaccacatgatgctgatgcttcccttcctatgtgattttttggtatttcttttgcagcctgcttgaagtgacataatgaccagatacgtttgtgaggatgctgactgggatttggtcagaggccccggtaggcccactgaattcttaccgtacatcagtgacctcataacctttcaagctttctattcatgaagctcaaaacacccctctcagtaacatacacacatcacttgatagattttgcattttcttggctcttaatatactcaaatgcctttttcatttaaatctagagtttgatctggatgaaataatgcatttttccatatataggcatttctgctacgtgcaatgtattttcctaacaaacaaacaaaaagacaccccactctgccagataatgtattaaaataatagtgcttccgtaagagttagagtggaacactcaatccctatacaactcaaaccagatgcttacaaaatgttaacagcccttaaaaaaaggccacatatagagtcgaggacacataaacttctaacaacgacaaaaacaaaaatacagggtaactattgaatctgctttttttggaagtgaaagttatttgataagaaatttgggaaagggttgaggctgccgagttagggtggccaggacaagaggcacataggaacagcaaaatcagcatctctatgacagagtatctggtcaaactgagccaagaagagtgtggtgtggatggctgtcgtgatctcatcatagcagagagatcaccccactgagggcttgctgccttggctgcgttagtgttctctgccttcgactgctcttacttacaaccaaacttcagtgtgccagggaaaggacatgtttgaatcaacatgattttcttgtcatactaaaacaagtcctttactttgcattatagaaacatgttatttttagccctacagttgatttctaatcctcgtaggacaattcccaaggatgtttaagatctatttgaactttgagtttcacctgccttctataatcatgacagtggagactccccattctacatattctttctggacagttacctgtgatctagtcttcagctaccttctgtatgccagaacttcatctctagtttaggtccctctgttcgtcttcaggctcataaggatgtacatattgatcactggagctctctatccagatattgtgcaggacacctcaaagtcaaggtgtccaagatgaaacatgtacatatatatacaccattctctccccgtgtcaaaggcaaccacatccactcagtttttcaggaatgccagtattgtctaggaaagactatctgcgtcatatttctatagttaattactaagttttagctatctaagactttttttttttttgagatagagtctcactctgtcgcccacgctggagtgcaatggcatgatctcggctcactgcaacctctgcttcctgggttcaagcgattctcctgcctcagcctcctgagtagctgggactacaggtgtgtgccaccacgcctggctcatttttgtatttttagtagagacagggtttcaacatattgcccaggatggtcttgatctcctgaccttgtgattcgcctgcctcagcctcccaaagtgctgggattacaggtgtcagccaccgtgccctgcatgtctaagactttatacaacattaaagtccacttatctctatcccactgccactaccccagcccagcttctagctgagaactgcaaccaaatatcaagttttgtgacagtgtaaactattttgatcccaacctgaagccagtcaaaataaataaataaataaataaaaaataatctttctctgccaatctcttgtttaccactttggtggatatatatttactttggaattaagtacacattttttagatgtgcaaggccctgcctattttctcccaaataacttttgctgatgaggagcttgacttactcctccttccagtcctttctacgtaataatggtgccctctgagccttcttgttccttcaaaccctattaggatggaagaagtgacgcttgagtagaatccttaactatttctttgaaactgtttctggctttggtgctttgtgtactcactacagccattttaccatagtttctagatcatgactgtccagtgacttttctgactcttccatgaggatagtttccttgaggcaagaactcgctatattttctggcctttatatagtttgggtgctcacatttggccaaattggtgtttacactgtggtgaggagaagctgcagcctgtgaccctggactcactgaagactcctcgttaatcaagcggccatccttattcggaagagccccaagcatactcacctgttcatttttctctgccgaggcagttgtccgcttgtgagaccattgccttgtgtagagaattccggatttcttgggcctcattctgaaaaggataacgattatcctctcttggaggttgctatgctagagctataaagtcaaaagtaagcataaatttaggcgtgaattagaatgtggaaattagcattactgtcagtcaaaacggggcttttggggctcctgagtctccgttgttgacaggtcagggatagaaaatgaatgagctagtaggaattgttttgaagaccccacgtcttcaaagacggaaagaatgatcaagaatgaacccctgaaattttctttttttcttttttctttttttttgagacagagtttcattcttgttgcccaggctggagtgcagtggcacaatctcagctcactacaacctctgcctaccggattcaagcgattctcctgcctcagcctcccgagtagctgggattacaggcatgtgccaccacgccaggctaattttgtatttttagtagagacggggtttctccatgttggtcaggctggtctcgaactcccaacttcaggtgatctgcccacctcggcctcccaaagtgctgggactatgggcgtaagccactgctcccagcctgaaattttcagagtagacaatcttaccttgaagatgacttttgccttcccagtgatgaattttgagagagacttgtgttgctgagacagaacacgagtctcacacaggagcatcaactctgtcaacacaagccttcaggctttttgggtgcatctcacatatgctattcttgaaatccattacatgacatctcagatgctttgccatctcagccatcatcccctactgcacagcaaaccttggagccataaccagatgttcctttccatctccctagaggcactcacagcaaggcctgcgtgcacctgcaattacaagtggtttgatcaaatgatgcgaatggatagaacaagtcagctctttcttgaaatctggtagatccaagctagccttcatactttgcagggaggaagagaaggattaaggagagaaaaatcaataaaaacctctcatcttgacctgatttttttgcagcaacaggaatttgtctttaatgtcagctcacgatcacatgccttcatcttctgagtcacactctgactgagtcacacttgccattcttagcctgtatagaagttgtctgggactttcctccctccaccctacacctccctcagaatgttactgtctacccacactcatctgggaactctcatttggaatgaggggagggaggcacagttttgctaagaggcagaataaaagcatgccccgggtgccagcctccagctgcctgggaacccagtctttgtgaggtggttttatttgtgaaagtcgtgattcttaacttcttaacttcattgcatgttagaatcacctgaaaagtgacaacaattctgattctttttttgttttttttagacggagtctcgctccgctgcccaggctggagtgcagtggcgtgatctcagctcactgcaacttctgcctcccaggttcaagtgattctcctgcctcagcctcccgagtagctgggattacaggcatgtgccaccacacccagctaccttttgtattttttagtgaagactgggtttatccatgttgatcaggctggtctcgaacacctgacctcaggtggtctgcctgcctcgacctcccaaaatgcccagattacaggcgtgagccacggtgcctggccttgctggctccttttgaaagccctgtcataaacttacctagaagtaagcgctctcttctctggccttaccaactgcggctacaagtaatcaatgagcatgggaggagtgtccccaggcagcatctggcaccaattattattggatagttcaggggccaggggaacctcagcccatccactgccagggacggacttgacaggatccttgcccagcaagcctccttttggtcacaaaactcaaggagtctggttgccagccaaactccttgagttctgcatttgtggctcattcagttctgtggaaatggcagcatggctctgtggttgatagcctggactctgaaataaggccacctctgggccgggcgcagtggctcacgcctgtaatcccagcactttgggaggctaaggtgggtggatcacaaggtcaggagtttgagaccagcctgaccaacatggagaaactccgtctctattaaaaacaaaaaaaatcagccaggcgtggtggtgggcacctgtaatcccagctactcaggaggctgaggcaggagaatcgctggaacctgggaggcagaggttacagttagcagaggtcgagccactgcactccagcctgggcaacaaagggagaccccatctcaaaaaaaaaaaaaaaaaaaaaaaaaaaggccacctctgtgaatctaagagaactcacataactagagtttgttttctcatctgtaaatggggcaggaactcatgtccacctcacagggtcacatgttgaaagtgttcagaatggtgtctggcaagaattgggtgccattagaacaactagtctcgtttctttccgttaaagatcctattttttgcaggggggtgagaggtagagtcttatggataaatgttaagatttctgggccgggcgcggtggctcacacttgtaatcccagcgctttgggaggccaagacgggtgaatcacaaggtcaggagttcaagaccagcctggccaagatggtgaaaccccgtctctactaaaaatacaaaaattagccgggcatggtggtgggcacctgtcatcccagctactcgggaggctgaggcagggaattgcttgaatctgggaagaggaagttgcagtgagccgagattgcgccactgcactccagcctgggcgacagagagagagtgcctcaaaaaaaaaaaaaaaaaaaagatttccctaagaaaagcaaaaagtggactttctcattaaggaagtggtgtgcacttatagtcccagctacttgggaagctgaggcaggaggatcacttgagcccaggagttcaaggccagcctgggcagcatagcaagactctgtctctacagaaacaaacaaacaaacaaacaaacaaaaaaaacagatgaggaaacaacgtgtatatacttaagcatctgtttccctataaaatactagtttaatgtgggatgattatttatttcctaatatactgggtgtattacaccacctagaacttaaaaggtttttaataattcctgcagaattaagtgatagaagcaagcacagaacaagtgacctttgatctcaagagtttttctaaattaatctgctattattctttaccaatattaaatcctatacacatggtagtaattcaaattatttatctctaataatctcaaaccccagaatctgcattagaatgagggaagaagttaaactataactccttttttttgagacggtgtctcactcttgtcgcccaggctggagtgcaatggcatgatctcggctcactgcaacctctgccccctgggctcaagtgattctcctgcctcagtctcccaagtagctgggattacagatgcctgccaccatgcccggctaatttttctatttttagtagagatggggtttcaccatgttggccaggctggtcttgaactcctgacctcaggtgatccacccaccttagcctcccaaagtgttgggattacaggcgtgagccaccgcgcctggccttagactataactcctaaatgtcaaccaagtgtttaaattcttatttgtcttatttgtttgaactgcttttcaaagtttcctgcccaggctccccaacttacacaatttctttttgacttctcccccatttttttaaatctctttaagagacaagtacataaagcacccagcagaaagcctgaaacaaggaaattttcttcatttaacatttattaaagcaaggggatgaacaatatagcctttattctccagaaacaaacaaagcacctccccctaaatcctcagggaagctacgcagatggaagctctagagagcacctcccagtgtccaagctgggcaactggttgagagtggctgggttccacacaccaggaaacctgtgcagttacagtgcccggaaccttccccacagatatggccccatgtcttgctgtgtaatgttaaaggcgaatattgtcaagctgaattgtgtctttaaatatttcagagataacaagagtgttgcgatttttgtttgtttgtttgtaatattttgactcaccgtcaatcagattacacattttatttctgaaatattcagtgagttttctcactcctaaatagtagcttatctcttcagttgaaatacgtgttagtccgtaaaggtccagatcgaataccatttctcccggaagttttttctaattgttccagcaagaatgtcatgttcccgccactaaaatgccaaagcagttaattaatttaaattctaccactctcagggcacacgtcttttcatttcgtagatttttcttcttcttttgcacgtatatcttctgctcccaaagaagagaaataatttttagtcactttcagcactgagctcattgctctctatataatagaggcgcaatatctaatcgttaaataaataaaagctgccattgaagttgcaaactattaaaaaattttattatatcacagctgaaaccaatcttcagagacaattttatccttaaagctgaggaaaattgcttcattaattggcttactccaagtcacacctcacatttcttagctcctactctattctccaatatttctttactgaaaaaactgctgacaaattatttagaaggtatatgtgtgtgtgtgtgtctgtgtgtgtatttggagacagggtcttgctctgtcacccagggtggaatgaagtgacaatcatagctcactgcagccttgaattcctgagctcaagagatcctcatacctcagcctcccaagtagctgggactataggcacacatcaccactcctagctaaatatatatatatatatatatatatatttatatttagagacagggtttctctatgttgcccaggctggtctcaaacccttggtttcaaactgttcccccactcttcgttttattttttaattttaatttttttattttttttgagatggagtctcactcttgtcgcccaggctggagtgtaatggcacgattccgcctcctgggttcaagcgattctcctgcctcagactcccaagtagctgggattacagatgctcaccaccacgcctggctaatttaaaaattatttttggtagaggcggggtttctccacgttggccaggctggtttcgaactcctgacctcaagtgatcccccaagtgatccgcccaccttggcctcccaaagtgctaggattatgggtatgagccaccgtgcctggcctccccaactcagtttagcaccttctcacttttccctcccccagtccctggaaaccacccttctactttctgcttctgagtttgactatgtcaggtaacttgtagaaggggaatcatgtggtatttgttctctgtgcttgacttatttcatttagtataatgtcctcaaggtccatccatgctgtagcatatgacaggccttccttttcaagactgacttgaatatgtatagtatattcaagagagtatattcaatatagtgcattcaatatatgtattggtatgtgtagatctcattttctttatccattcattcctcgatggacatttaattgtttcctcatctccgctattttttaaattgttttgagacggggtcttactctgttgcccaggctggattgcagtggcactatcacagctcactgcagccttgacatcttgggctcaaatgatcctcccacctcagctggactaaggaccacaagcatggaccactacgcctggctaatttaaaaagaagtttttttgtagagaagggtctggctatgttgcccaggctgaattcctgctctcaagcaatcctcctaccttgaccttccaaagtgctgggattatggcatgagtcaccatgcctggtccctcatctcatagcaattgcccctattttggatttccaccaacggggttccaatttcttcacatcctccccaacttttgttgtctgttttttgtttgttttctgttttttgataatagccatgtaacaggtgagaggtgctctctttgtgattgtagatttgcatttccctgatgattagtgatattgagcatcttttcatatacctgttagcctttctatgtcttctttggagaaatatctgactctttggtccatattgttatctggctattagtttttttgctattcagttatagaagttccttatatatcttgggaattaaccccttatctgacatgtgatttgcaaacagagtcagccctccaaatctatgggatctgcatctgttgattcaatcaaccgtggatcaaaaatattttttaaaagactcattatggggccagtcatggtgggtcacacctgtaatcctagcactttgggaggcggaggtgggaggatggcttcaggccaggagcctgaggtcagcctgggcaacatacaaagaacatatctctacaaataaaataaaataaataaaaactatacaggcatggtggtgtgcacttgttgtcccagcaactcaaaaggctgaggtgggaggatcactgcagccctgggggcctgaagctacaatgagctatgattgcaccactgcattccagcctgggtgacaaactgagaccctgtctcaaaaaaaaaaaattatgttccttaccttgtttaaaaattgttctttctagcacttataactacttaatatatatctgtttttgatcttatgcttctccttactaaaatataaattccatgatggtagagattttcctttattttttcctaatttctcatttataaagaaaaagctggggtgttcatgttatttgtatttctttcacatgtgtggttctttgatcttctgaaaatgttatataatattttataattttatcactcctgtgcctaaaatctctagcaattcccatcgattacagaaagaatttcaaaacttggcgtaacacagaagcctattgtgattggctctctgctcaccctcacctccagcccgactcccacttcgtcaggttctacagtctgccaaaacctctaagttttctatttttgaagtttttttgtatttagaatgttaactatttggatgccacatgcagagtgtgggggaaaaaagcaagagcattaaaaatactttaatacttaaaaataaataataaatgtgaaagtctgcaaatgtaggcttttttgggtcattctctaaacaacacagtataacatcgatttacatagcatttacattgtattaggtattacatgtaatctagagatgatttataagtatacaggaggatgtgcagggttaatgcaaatattatgtcattttttttccgggactggagtatccctgaattttggtatctgcaggaggtcctggaatgagtctcctgcagacgctgaggggccactgcattttctttcgttccgcagaatatgcatcttcacgctgtcgatcgtttcctctgctgtgcaggagctttttggcttgatgtagttccctttgtctgttgttgctttttttgaccatgcttttagtgtcacagtcatgaaattccatacttcttctgtgctttcatctacacaaatacatatgtcaacatctatagcatgacctcttatttttaggaaaaatacacaaatagtggaatataatttttattatttagacaaactatttttgagggcaaaaatttatttccccttaatgtcatataatggatgtcatatcatgttaatgtatgtaaacagatctgctttttaaaaaatgtctatgtagtaagatgaagggctattattttggcctggtgtgatggctcacgcctatagtttcagcgctttgcgaggccatgacaggtggatcacttgaggtcaggagtttgagaccagcctggccaacgtggtgaaactccatctctgctaaaaatacaaaaattagccaggcatggtggtgcacatctgtaatccccagttactcgggaggctgagacatgataatcgcttgagcctgggagccggaggttgcagtgagctgagatcacgccactgcactccagcctgggcgacagagcaagattccgtctcaaaaaaaaaataatagtaataaaagctattattttaagtatacattcatgtaagactgctccataatttcagagtatatatttgacaactgttgcaaattctctttcctagaaatatataaataaggtgaaaaaagcaataaaaaaggaaacatatgagtagaaattcatacttgggaaaaaatagacacactcccccctgcccacgcacacacacatatatcctgtatttatctacctggaatatacttcggtataagttgctgggtagagatcaactgaatttatttttccagatgactccctgactttccctaaactgtgtgttgagtaacctatcttttccagactggcatgaaatgacagatatacagaggacccttgaacaacctgggtttgaactcctcaacatggacacttatacacggatttttctcaataaaagtgacaccaagaatgcctgcctctcctgctcagccttccacttcctctacctatctggcctctgccacccctgagacagcgagaccagccctcccacccccacctcctcctcctcagcctactcaaagtggtaacgacaagggtgaagacctttatgaggatccgctttcacttagtgaatagattttctcgtaataacattttcttttctctagcttatttgataagaataaaataatacatgtaacaaaaaaatatattaattgactgtttctgttattgataaggcttggtcaacagtagactattagtagttaatgttctaggaaagttaaagtgtatttttgactgtgcaaggggtcagcacctgtaacccctgcattgctcaagggtcaattgtatttttttaatctcgctctgtgcccaggctggagtgcaccggtgatcatgtctcactgctggcttcgtctcctgggttcaagtgattctcgtgcctcagcgccgagtagctgggattacaggcacccgccatcacgcccggctaatttttgtatttttgtagagacagggtttcaccatattggccaggctggtcttgaactcctgacctcaggtgatccacctgccttggcctcccaaagtgctgggattactggggtaagccactgggcctggctaactttatttttaaagctaggctttcaagcaatgtatttttcaaataagctcccaactagtccaccgcctcatcaacaaataagcccttactgtatctataaagttcatttttttctgcatgtgccaaccctgatggcatctgggtgatagttgtgacagtgaccctcttggagtactcctagcatcaccctctcaggagagaaaggccagagaagaagctacttgagttgttgatctcagaagccgtgtctggtagtgtgattgggtcatatattttgggaaggctggtctattctatgaatgcatttcatctatgaattaagcccaagcaaaatgttgagaaagatggtaaggaagtctgccttcccaagagtgaatgtggtcagtgatttcagatgcctgtcacaccatcactccataatgacagctgtctgacttccttctcacagcaattggacaatgttcatttttttttttgagatggagtcttgctctgtctcccaggctggagtgcagtggagcgatctcggctctctgcaagctccgcctcccgggttcacgccattctcctgtcttagtctccctagtagctgggactacaggttcccaccaccacatccggctaattttttgtatttttttagtagagatggggtttcaccgtgttagccaggatggtctagatctccggacctcgtgatccacctgccttggcctcccaaaatgctgggattacaggtgtgagccaccgcgcctggcctgcaatgttcattttattgagataactggaaattttcacccactcacaagtcaacaagtggatgcagtatagtgtgttgacaaaagagaaagactgggaggtaggcgctccagtttcctagtcctaatccggcgtatgtggtaagtgagtatcaggagatgaatttaatttattctagcctcagttttcctcagcatctgtagaaggtagttggactatatgatctcttgacttccagctaaatataagactatgattccataataatatagttcctctattcatttataactcattaacagaaaaatcgagccacgtgcaaagaattcttgtagtcatcaatgaataacacgtggttattgtgttacgatgcctataaaataaaaaaaattatctggaagagggaaacgggatagagcagatcagtgtgacttgaacagagactatgccagcctccctattccaaattggaatactggctctgtgatgtgctataactgtattgtgaggcttattctaatgattttggtaaatgttaaagactcctcctggggttgtgttgaaataacacactgaatggagatggtagttcataaattctttttctagtggtggcagttagtgttattgtagtctttttttttttttttttttttttttgagatgggatctttctctgtctcccaagctggagtgcagtggtgggatcttggctcactgcaacctccacctcttgggttcaagtgattctcctgcctcagcctcccaagtagctgggattacaggcgtgcaacaccacacccagctatttttactttttttttttttttttttgagacagagtttcgcttttgttgcccaggctggagtgcaatggcgtgatctcacctcactgcaacctccacctcctgggttcaagcaattcttctgtctcagcctcctgactagctgggattacaggcatgtgccaccatgcccggctaattttgtatttttagtagagacggagtttctccatgttggccaggctggtctcgaactcccgacctcaagtgatctgcctgcctcagcctcccaaagtgctgggattacaggcatgaaccactgcacccggcctaattttcatatttttagtagagacggagtttcaccatgttggccaggctggtcttaaactcctgacctcaagtgatccacccacctcggcctcccaaactgctgggattacagatgtgagcaaccgcgcctggccaaactttttttctttttttttttaagactcttacaagactaactcatagcaatattctgaagctgtgacaagttagtatcctggaggctatcttggtagaggtttcatgatgccaccctgatgccacctctcttcctctttacagtagtataactctttgctcttattttttcatagcttaaattctcatcctagcaattcacgtatgctttacaagggatgtataggattgaaacattttgaattaatgatttcagaaaggtgagttttgactaggagaaaggaaggtggaggaaaaaacattctcagccagaaaacttctttttcccaaagttcaagataagaaaacatccaacatcctgttggaggtaagtgggaaagaagtagcagttggagccttgaaagtcagaaaccaatgaacggaacagcctgagtaatggacccgactcgtggaaggctgccaagctggagagtgaggggacggagacagaaatatggcgtgatgagttcgtgggaaggtcaaactcgctggcctttgaggaagagcttttgaggtgcaacttcctggcatgcagtgagcagaaggcaggccaggacaggagctgactcccgagcaggggacacagtgaatttgtggcatttgttaccaatctcggagttcactgtgcacagtctccacactaggcatttactttttcatatgtccgaaaaaatgtctgcacacttcatttctgtccagtaagaactgataatcagggatttgaaggggcctagtttggaaattttcaatgggtgaaaataagtgagcaaaattacatttatactaaaatataattctttccatctgctccatagtgggatagcctcttgaggcaacttccaattagaatgtcattttagatgctttccaagatggcagatgggtgagtactagggtgtgcagggaagatcaataaacagctctggcaattcatcgtgcgcctaacaccaaggaatacttcagtggaagagctctcattttgttgggatgaataaaattaaataaaagtacacagtacccaataaaggaacaaaagcttaggctttggtcaagcagaacaaaaggggctaatgagaaaaggactatgtattacagttttcttctctcagttctcaactaggttttattagtggagttcccaaaagatttggaccaaatttccaattcagatattattagagatcatcaaaactcaaatctctttactggtttacaccaaatcacccaagcttccagcctaaaacccacatgctcacatggttccacagtgctgtttatgtacaataaccagttctcaaaatggtaatcctgttagaagccagaatcctcagcctctagcatgtgtgcttttcacagagataagtctcaaagtttggggttggtgaggagcccagtatacaggagttccacattaagtcataattggctttgtgttggacagtgtatgtcagctgg

SEQ ID NO: 618 - DNA, 779704 bp, Homo sapiens
cttcacgatctcttgttgttgtcttcaaaagttctacatcacagtttgcaccctataattatataaggaatttgaaatcttctttgatatatagtactgatagaaaggtgctactgatggtagtgcccaatttctatttaagaaaataagactatataatgaaaggaaattataaaaaataagtttaaaaaccacatctttttaaaacagcttcattccaaattattccacatttgcctgattacctcccaagtgctaattatgctgaggataaagaaccaatatcagtagtctactgtgccatcaaagagacctctgtctctcaacccctttgaaacagcaattcacagcaaatcaaaacaaattattttcaaattaggtaaaacaaagaataaaagccagtgtctgggcaacaaactccaaaatatttgtaagtttataaaacctacccgggcagttggtgatgggcgtcttggacttttagacctacttcgcatcatctttctcaaatgttgagcttcactcttatagtgatctttgtctgcttccaaagtcttgacaaaggaatcaagtctagaaggagatttattttgtgctttttcagtatctaaaattatcttgccaaagaggaaaaaattagaccattatttcaagctaaactatagcatcattttctaagtgaaattgaaaacaaacaggatccttaaaaacatttaatttggtattttttaaatacaacatttaaaaaattatatatcagtaatttttaaaaagcagttagatatctttcttttccaggatttctgggtatgctatattttaactgaaagataattttggagaaaaaatggtaaagaaattttagagaggccagaaatgtccacagacctagcacacatcctagaaatggcatggatttgctttagaaaaacatatgctactaggctgggcatggtggctcatgcctgtaatcccagcacattgggaggccgaggcgggcagatcatgaggtcaggagttcaagaccagcctggtcaacatggtgaaaccctgtctctactaaaaatacaaaaaaattagctgggcatggtggcgtgcacctgtagtcccagctatttgggaggttgaggcaggagaatcatttgaacccgggaggcggaggttgtggtgagccgagaatgcgccattgcactccagcctgggcaacaaagcaagactccatctcaaaagaagaaaaacacatgctactactaaagcaactgttatagcatctaagttttgtccaatattgttcaatgcgtgaataaattaactgaatgctggatattccatacttgtaagcattcccacaaatttgcattcactttcatatatttagaaacacttctttgacaacatttatttaacaatactttattgggagaaaattatagatatactttcagatagagggttttaaatattttaaataacactaaaatgtttaaacagaacagttttcatttcacattgttagataaataaaacattgtttggaattatgtaacaaaatttatggcttaaaagtatttactattaagggggataaaagttaatgtgtaaacaaacttcatattttgagaattattcagtcatcattttaaatcaattaacagataaggacattaataaaaccaaccaaaagttgttctttgcctctaggaaacaaaggaatagtgatgaaagcagcaaaaaaaagtcactcttacagatgggggttcccctgtgtccctagcagttggtgcagattttagaaaacaaacatattttattcctcacaaaacgtgtgagagccaaagatataattttttatagcttactgaccaaataaaaatgattccgtaacacatatttatgaaaaatgtacttacagatttaagcctttttattgtatcttccaatactataatattattttgctggcaaatgagatcaatctgaagaaaaagtaaaaaaaaaaaaaattatttctattaaagatgtttaaactaattggaaaaagaacatcaaaaaaaaggaagccacttaaaataaaaacatgaaggcagtgaatattttaaagaagaaataacctgtttagcaacctttgatgataaaagataaaagatgatttacccagaatgaaataacaattctcttaaattcaatcttttgtataaaatgttaattgattgtattttaccaaattattccccataaactggaacaaaatgttagtactaattacaattctgaagataataggaaagcaataaaagaatgactagaataaaataagttgacccaaattaccccattcagaaaagattgctttctcttctgaactcaactgcttagttcaattcaatccacaaaatactttttgtatcaatttatgacagtgaacatacccagtcttataagataggtacctatagtcatatatttagcatatgactacattatatgttcctacaggacagtgactaagtttttatgcaaagcagtaaagttctttgctaatagcatattcacttaatgtattttgcaattcatcaacctttccctcattattctaaactgcatcctgatcttgcctactacatttttaatttgaattctctggaattattgtacttcatttgtcctttagaccaacgttctcttctacgatttttctggcagtcatattttaagtttatgaaatattaaggggtgctattatttgcaacgtttttctcacaagtgaagtacttagaaatagaacataattacatagagtttggataaccttatgtatagccttgaatagacaattttcaatgttttaatgtatactactaagtagacactaaaaagatacaggtctactctgaatgtgttaagatttccacattaagtataaaaattcactctgcaaaacagagtatctggtatgacacattctcataaaaaataaatttatacgcagacatcctacatataaacataaccaaataaactgaagattatgtctaggtataacaaggtatgattatggtagatgttattttcttcatttacttttctatatggactaaaattttgtataataaatatgcattaattttacagtgatttaaaaaaatgttgattccactctgaaaaacaaaataactggcccaaatgaaaaactgctaactcagtgttttcacttacttaacaattaatgaatgcctactacctgcctgccattgtgttatgtgctgggtaaagtaatgaataaaaaaggtaaaaatctctgccctcatgtagtatatattctagccaaaaaaagaaaaacaaaagataatagtcaaaatatgttagtgattgcatccctcaaaaaaataatacaaggagcgctcacgttctaagcacttgagttaagtaaacaagagagacaaagatttctgcctttgtggattctacattccagctagaatagacaataataaacctaacaaataattatatagtatactagaaaaagaagagcagagttaaggatactgggaatatttatggaggaacaggttggaattttaaatagggtggtcaggaagtcctcattgaaaggtgacctttgaccaaaaacttcagaggaaaggaagtcaatcatgtgaaaatctgggcaaaaaacattgcaggcaaaagttacagctctaacaaaggtcctaaggcaaaagaaggtctggttggttctaagtatggagaccggcatggctggagcacagtgagggaaggggaaaggaacagcaaagtgctacagggaaaaataaagcgaaggagaaagacagggagtgtgtgcagggaatgtggggatgggtatttcagagcccgctgtgtggaagacattgtgtaaagtctttgttgtcccccaccccaccctttgtttgtgggggacaaacaaagactttacacaatgtcttccacacagcgggctctgaaatactttttattgaatcacacacaaaagtaacaataatgataaggactatcagagatccagtccagtaacatagcccctaggtcaattaaaaatataaattataggaagaaataatggtaaaattttaattctgcttcacatttcatagtgtcatgttcaattatctgggaaatgccatgttaacacatgaatgataaacaactcaagatgagagaataaacgaaggcatatagttgaggtggttttaatgtatgtccacaaattctaatactccttccttcaatagctggagcttaatttccctcccctagagtgtgggttatacttagtgactcacttttaaagattagaatatggaggaagtgatgagatataacttttgagactgggtcatgctaagccctgcagatcctccttattatctcttggattgttggctgggggagaggggaaggtggagggagaataaacttccacaaagaatacatgaagcaaccctagagagaggtccacctagcaaggaacaggcctcctgccaatagccaaaagccatctgagtgagccatcttagaagtagatcctccagtagcagtcaagccatgactgtggcaatcagcttttttgttgttgttttttgagatcgagtctctctttgtcatccaggctggagcgcagtggcgtgatctcggctcactgcaacctctgcctcccgggatcaagcaattctctggcctcagcctcccgggtagctgggattacaggtgcccaccaccatgcccagctagttttttgtatttttagtagagaccgggtttcatcatattggtcaggctggtcttgaactcctgacctgaagtgatctgcctgccttggcctcccaaagtgttggaattacaggtgtaaaccaccagccctggccatcatcttgataacaatttcctgagaaacagtgaaccagaacaacccagctaagccactcttgaattcccaacccaagaacctgtgaggtatcaatatttgttgtttgaaggcattaaggtttcaaagtaattacatagcaatagccaatagttaatattgaaaatattttaatgaagtaaatcatggaagaagttactgttgacctttaaaaataagactaaaagtaaatacttcccagtgaatacatttaatactatctcaattccagacaaactaacagtagctttagcctcagactctacctccgcatacccagagtataatcttaaacactagaaacccaaatattttttctcagcaatcgaattagaaatcttgtttcaagtgccaccccacaaattaggcaaggaatctctcccacataaatataaacctaaaatgcatatctaatgtcttaggatgatgacaacacacactggagttcatatccccagtgttggttttgcatctttctaatccccattctacttggggacattcacttaactgaggttggtgatttcctcatttcagggcattctaccaacccaaaggcctatttccattttgttctctctttattaagtttctgatgtttttcctgtgtcagcaatggtatctctactccaagacttactgcttacctctttttcacccaatagctttccaaccctcaaatacacccaacattccacattatttatgaagatctattttctagaaatactctttgccaaaccaggcaaaattccacctgtaaatttaatacttacagttttaggtaaatcctagctcttatattttagatgttttccattccaaaaattcttccttttgaaagcagagaatttaccctgacatagtacttactctctctagaacataaaccctaacaaccctttaaaagtgatgtgatgacttctaaacagggcattctcattgttggaattcagtcaacttggtttcccgcagtctgggaaggagtgcagttaatttttaatttgaaaacaaaaacaaggaagacatactaaaactcttcaatattgatatatatatatttttttgagataaagagtctcactcttttgctcaggctagagcgtgacgtgattttggctcactgcaacctctgtctctcaggctcaagctattcttgtgcctcagcctcccaagtagctgggattacaggcgtatggcaacacgcccagctatttttttgcattttagtagaaatggggtttcatcatgttcaccaggctggtctcaaactcctggcctcaagcgatccacctgcctcggcctcccaaagtgctgggattacaggcataagccaccatgcttggcccaattttgataatttttataattaagacagatggaaatcaatttaccattaaactgtgaatgttactttaaaaaaagtaacaatacattccacctgaagtggcattaaaaaattaagttaaaaaaaattttaaagtaacaatacaaacaaaagtattgaaaaatgtttaaaatattcaagctacttttaaatatccttcaaatactttaacagcatccatttgaagataaataattcaaaagttaaaaacaaatcattcttatctagtatttcaagcagttctaaggacctgttccagacaacatggttaaagaagactgtatccttaaagtaataactcgtgtatttaaatattgcactattatggccaggtgtggtggctcatgcctgtaatcccagcactttgggaggccaaggtgggcggatcacttcaggtcaggagttcaataccagcctggccaacatgatgaaaccctatttctactaaaaatatgaaaattagatgggtgtggtcgtgggtgcctgtaatcccagctactcgggagactgaggcaggaaatcacttgaacccgggaggtggaggttgcagtgagccgagatcgcgccactgcactccagcctgggtgacagacggaaactctgtctcaacaacaacaaaaaagttctattatttgactttccactaatttaaactcatccattaagcagtctcaatgaggttactgcataaaaatacatacaatcctagaggtcatcaattggactcatatttcaaattactttaacagtgacttcaataacgtttcacctgataatttaattgctttattatttgctataagagtcctgttacattaaaagaatgtttaagaaataacacgtaataacaattagctttgggaaattactctgttacagacacaatttactaatttggtgattaataaaatcaagacaaataagcatgttcacaagctatcatttaaaaattcaacaggttgttttttggccttcaaatatgctctatcttgcttatcagccattaggcagcaatggagaagtgagactgtcattttataattacatttaatctctagtttctaaatttcatggcaaagtactcaatcaagaaaaaaaatgttgatcaaaatatcataaagctacagtaactaaaacaatgtgatggtggcacagaaaaaggcaaatgaatcaatgaaaacaaatagtccagaaagtcacagatatctgagaatttagtatctgttaaaatgatatgtcaagtcagtggagaaaggactaggcaaccctacctcatattagaacaaaaagaaactagcagtatcaacagaaggaaaactattaaaaagtattaaaagaaaactttagaaagtatatctgtagttcttgaggtgaaaaaaaaaccttcctgaacaagaaccaaatctcagacatcagtaagaaaaaaaaaagattggcaaattttcaaatgttagttaaaaaaaagttttaaattgactttttattgatacataataatggtacatgtttatggggtacatgtgatattttaatacatgcatcaacgtatactgatcaaatcagggtaatggggatatccatcaccttaaaaattatttctttgttctgggaatactccaaatcttctctttcagctatttttaaatatgcaataaattgttaatgatagtcaccctactgtgccatcaaacactagaatttatatcttctctataactgtatttttgtaccaattaaccagccttgattccatatcttggctattgtgaatagtgctgccataaacacggaagtgcagatacctctgtgacatactgatttcctttcttttggatgtatacccggctgcggtgttgctggatcacatggcagttctatttttagtttggtaaaaatcttttttaatgggtattgaaatcaattacatatgtgaaaatagacgaaaataaatgtatctattagtttgtagatatctctgcagaggagagaggaattgggaagtgggagcaacatttagttcacggaacattcctgttgctttcaaattttttacaatgactgcatattacttaggaaatgttttgagtagaatttgttaaaagaagtaaaatgtgagaaacaatttaatccttagaacagacatttaaatatactgtcaaatctaaaaagcttccaaattatacaaatgagaatgctactttttccattgcatttaaaaattacatgatgtttaaagtaaaattaaaatccttatccgtggtaaatctggtaccttggcttcttcaagttccttgttggcggaatccaccacaaaatttttctctttttcgagttgctctgctagttggtcaattttaatcaattctttacaaagatgctcattgtggctggttaaatcatctacttgactgcttaccacctccttactatccaagagtttcctaacatattcttccaagccatgatttgtctgtttgagatcttcaatctgttattatcagaaaaaaaatcacattaaaataattccttagcttttttctggggagcagctgtgtgactggaatcaggaagggagatttgcttccctggcaaagaaacttaactctatacctttttgtgccttctgaattttgtaccatgtgaatgtattacctatttgaaaaaatatattaaataaacattttaaattttatagcaatatctttcaagacaatttatagtttattttaaaaagaacttaattactattgatttttagccaatctattagaaaaatggccaaatatttatatctgcaataaagaaacttcaatagctttgaaattaattttaataccattaagagttcttttaattaaatttctaattattgttattaaaatatattaactcttttaggccaggcatggtgactcacacttgtaatcccagcactttgggaggctgaggcgggcagatcatctgaggtcaggagtttgagaccagcctcgccaacatggtgaaaccccatctctactaaaaatacaaaaatcagccgggcatggtggcgagtgcccgtagtcccagctacttgggaggctgaggtacaagaattgcttgaacctgggaggcagagattgcactgagcccagatcctgccactgcactccagccttggtgacacagcaagactctatctcaaaaaaaaaaaaaaaaaagtatatatacatatatatatacgtatatatatgtgtattattaactttttaaaaagtccttttgaaagtatcagtaacttacttgactaagctaaatatcaaatcaatcaagtatttgctgcctaatgtggaggaacacagctttccttcccagcccactatcaaaccatcaatggatgaagaaaagggccttttctatcacaaaggtatccaaatgcctttaaaggaaaaaaaaaattagacccattgaacaatgattatgtcaggaactatattaaattccaaaaatacaaagataggttagatacctgccctcagggaactctttgtttacttgaggaaatacaaagacaacatgttaagtgcaataacaaaaataactacgaggtaaagtcatggtacaaattcttttccatagtacttgtctctcattgtgtatttaacaaatatttattgagcacctattgtgtctaagatactgtgttagtaccctgtaaaagatgcattaaaaacaacagcaacaaaaaaaaacactcgcacacagaagtttcagtctgtaaggagcatctgaaattgctaaatacctgacctcttagttctagcattattcttgccctgaggttgcccttttcaaacagctatagagttatcgtcttccaaaccattaaaaacaaagttgtcttcaaaaaaactttataagttgtcactacataaaaatatcctaagtcatgaattatttttaaatatgctacaatgccatttattgtacccagtaaatagcccaccaagaggcataattaaagtcattattttaatccagtgtctcctactctcttctcttttggccttctcccatctgctctcaaaaattcttcgaaaatgcaaatttgaggtcattcctataaccttatgttgcctcatgacactgagaatgaaattttaaaatgccatttatgatccaactcgacttagctgtccaacctaacttcccaccaccagacacactataaaaaacaatctcattaaattcatttaaaaacttcttttaggggagttattgaaatgtacacacttgaaattgaagtgttatcaaagaaccctccttatgagaatcctcaaggaaaaccctacttaggcttcaatttcaggaaaatacgtgccttttttggaaacctggtttgttcttaccctaacaatcattaattatttaactaatatttctatttgcctttgcctctagaaattttaaagcttaatccaaagcccacctctagcaacatgcacagaaactaggtacaatgatctgttcgttattgtcatcccaggctttcactgtttacttattttaccctacccttattatttcagctactttcttttaaaacaaacagacaaactacaggacgtgaaacagataaacttcaagttgtgtttttcatctttgttcgtggcttttcctatgccatgtttctcagcaacaagagcacactaaaaatgtctgttaacttcccactgcaccaggagatgttcttggtgcttctcctttccagtatgtgtgcccataaagcctcttatataagtttatctcaatattttataagatgcattaaaatcatttatttccctgtcccttctactagattctaaacaacttaaaagactgtattgtctcatttctgtatcaacacatcacttgtttctgcatcatttattacgtatctcacatataatcctcaaattattaagtaagcaaataaaacaaattattagtaatataaatgaacactcccctcccttctctcatgaactttacttttactcaattccaagacaaaagtactttagaagaggcagtctggagtaacacaaaggatatgggctctggacttcggcagagttaggtttaaatcctgttgtagttctttaccagttatgtaattggggaatttaccatattttcttgatcctagaagatgcacctgacttaagaaaaaaaataaatgagagtctcttgagtttcttctgttaaagggacagaatgcctagaatttgcagaattgtcattagacattatataagagctcaagtaaaatttccagtattataggtactcaattagttttgttaaaaatttttatttttaaataagattcacaggaagcaaatgtagtacagagaagtctcatacgccctttactcagtttccgctgatagttgtgtcataaacaacatagtatatcatacccagatacaccatgtgcatggtgttctatatgatttttctcacatgtgcagatctctgtaactaccacctcaagatatagaactgttccattacaacgagaccattcttctgctgcccctttatattctccttccccgccctcaattcttcccaccaatgtgtacaattttgtcattttgagaatgttacataaacaaaatcatagagcatgtgatcttttgagattgctttctttcactcagcacagcgtcctttagatccacgcaagttgttatttgaaccaaataggatcattcctatttattgctgaataatattccatggtatggaataccacagtttaaccattcaccaattaaggaaaactggttgtttccagtttgggaatataacaaagccgctatgaacaactgagtaggatataagttttgagtagatataagttttcctttctctggaataaatgcccaggagcacaactgctgggttgtatggtaaatgtatgtttagtcttaccaaaaactgccaaatcattttccagagtggctgtaccatttcatattcttaccaggaatggatgagtgatccagtttctcctcatccttgccagcatttggtattgtcactattttttattttagttactgtattgttatttcatcatggccttaatttgcattcccctgatgtttacagaggctgaacatctttttctagtataccagacatccttctgtgaagtatatatattcatatatatatatgtgtgtatatatatttgagacagaatctcattctcacccaggctggagtgcagtggtacaatctcagttcactgcaacctgcctcctgggttcaagtgatcctcccacctcagcctctcaagtagctgggactacaggcatgcaccacctgcctagataatttgtgtaatttttagtagagatggggttttgccatgttggccaggccggtcttgaactcctggcctcaagtgatccatccacctgccaaagtgcagggattatagccacgagccaccacacccggccaaaaacttcaattttgattaagtccatattaccaatttttccttttatgagtcatgcttttggtatcatatctaagaactttccatccaagcctaacttcctgcaaattttctcctatgttacctcctaaaagtctcatagttttatgttttacatttacatctatggtccatttaattttttatgaagtgtgagatttaagtggagggtaactgttttccctgtatctaaatgctccaacaccacttgttgaaaagactatcttccactgaactgcatctgcatctctgtcaaaaaatcgtttggctgtacttgtataggactatctctagattctctgttctgtaccattcatgtatgtatctatccctcaccaatatcacagtcttgattactgtagttataagtgttgaaatcatgaagagttttgtttttggtgccttcctgtggattatctcaacattttttagaattctacgttgatttatttatagtgtttctgagtgtaactcttgtttgatctttttctaccagttgttctaggcattacattatatatacagaacttatcatagcctacattttaacagttcaagtgaaagtacagaaaccttacctgttagctccctttactctcccctattaataaaataatttaaatatttcctgtacatgcatttaaaaccacattcgacagttaaatacaattttgtaaaattaaaaaaaaatttgaatcggagtagtggctcacatctgtaatcccaggactttgggaggctgaggcagtggatcacttaagaatgggagttcaagacaagcctgggaaacatggcaaaactccatctctaccaaaaaaaaaaaaaaaaaaaaaaaaaatcagccaaccatggtggtgcatgcctgcagtcccaattacttgaacggctgaggtaggaggattgcttgagcccaggaggccaaggctgcagtaagcagagatgatgccactgcactacagcctggatgacagagcaagaccctgtctccaaaaaaaaaaaagaaagaaagaaattctgtttcatttacccatattttttgctctatatattgttcttccttcctactgctccaagattacttcttttatcacttcctttctggttagagaaatacttttagctattcttttagggtagctctgctggcacaaattatcttaatttttctttatctgagaatgtctttactttccctcaaccttcaaggatactttctctggatataaaattctgagttgacaggtttgcttttttctagcacttgaaaaatgtcgtgccacttccttcttacctccagtttttcagatgaaaaataactgctgtcacttgaattggtgttcttctatagataatgcatggtttctctctggttactttcaggatttttttagtgtcttggcatgcatttctttgggtgactcctgttaggtattccatcaccttctttcatctgttttatgtctttgtgtcaaatttgtgggaaattcagccattatctcatcaaatttttttagcaccactttctctcacttttttgtcgaacatagttttacctgtctctgaggctctattcaaatttttttccatctattttctctctgatgttcacattaggtaattatttttctagtctcgtgttcactgattcattcctctcctccattctattgagaacattgagcttttattttcagttactttatttttaaagcttgttttattgtcacaaaatatatatacataattttcattttaacatttttaaagtatataattcagtggcattaagtatattcacaatgttgtacaaccatcaccactacctatttccagaatttttttattcccctcccccaaaaaactctgtacccattaaacaacaattctatctccataatttgcctattctaggcagaggtggaatcaagcattatttgtcttcctatgtctggcttattgtacttagtatgtttttgaggttcattcattttgcagcatgtatcagaatgtcattcctttttgaatctgagttatattccattgtaagcacatgccatattttgtttatccattcatttgttgacatttgggttttttctacctcttggctactgtgaataatgctgctatgagcatttgtatatacgtatctactggagtccgtgttttcaactctttaggatatatacctaggagtggaatagctggatcatattattagtctgtctttaaaattttgagaaaccatcaaatgattttcaccaaggtggctccattttacattcccatcggcaatgcaagtgttccaatttcttcacatcctcaccaacacttgttattttccattataacaaccaccctaatgggtatgaagtggtatctcatggttttgatttgcatttctttaatggttgatgatgttgagcatctttttcatgtatttattgacatttgtatatcttctttggagaaatgtctgttcaagtcctttgcccatttttgaattagatttttctggggggaaaggggctaattgtaggagtcctttgtatattctagatattaagcccttttcagatatgtaatttggaaatattttctctcatgtagttaacagactaagtttttggagtagttttaggtttacaaaaaattgattaggaagtacaaagagttcccacacactcctctctctcttcctcaacacagtttcctctattatttacattttgtattaatgtggtatatttgttacaattgatgaaataatactgttacattatatatatatatttttttgagacagaatctcggtctgtcgcccaggctggagtgcagcggcatgatcttggctcactgcaacctctgcctcccgggttcacacaattctcctgcctcggcctcctaagtagctgggactacaggcacccaccaccatgcccggctaatttttttctatttttagtagagacggggtttcaccgtgttagccaggatggtctcgatctcctgacctcatgatccgcccgcctcggcctcccaaagtgctgggattacaggtgtgagccactgcgcccggcctactgttacattattaataactagtatctataacttaccttagggttcactcttggcgttattcattctgtgagttttgacacacataggatgacatgtatccactattagtatatcatacagaatagtttcactcccctaaaaatcctgtgctccacctattcatcccctctccctccaattcctggtaactactgctctttttatggtttctatagttttatcatctccatatagttggaatcatacatttcgtagccttttcagctttgtaacatgttttcaaggttcactctgggtcttttcatggctacgtagctcatttttaaaatacactgaatactattccactgtataggtgtacaacagtttgcttatccattcatctattgaaagatatcttggttgcttccaagtttttggcaattataataatgctgctataaacattcataggctgatttttgtgtggaccagttactttattttttagttccaaaatgtccatttggttcttctttacatctcttattttttcctgagacaacttttcttcattcgtttccagcatgttcataattgcttgctgaagcatttatatgactgctttaaagtccttgccagataattgtaacatccgttccatttcagtgttggcttctcttgtcttttctcaaatcttcctgattctttggattacaatgccttttttaaaaattgagacctagcattgtaagactctggatcttatgttttagcaggcctcctgtgacaatgctccaactaaaaagaagggacattgccttatttctgttagatcaaagtagaagtccagttcctctacttggcatctgttgatatctggaaagggtggtgttcctagatactgctaggcaagaatgggagttcaggctccccactaggcctctgccattaccaccagcctgggaagaatcccagaggtgcctcattacagttccctacgtgtcccccactgacaccatggatgggtggcctttactgctgataggtggtagaagttcaggtctccaccacagcaagaaggagtgcctcttactataaagtaggagtagatggcttggctcctcatgttgtctctgctgacatcacggggttcagggcctccttatcccctggtgaggataaaagtcctagtttcccacttagccttctctgatatcaccctggtgtgggaggagtgggtaggtgtaggcacaagtggggcacaagtgtgtaggtgaggcacaagtggggctccttgttatagtctggcaagcgtggaaagtgtaggctctttacttggcctgagctggcaggaatggggctgtagttttttctgtggtatttgcttggagtggatagttactctcttaaaagttgtctgccttgataggctgctcctttcctggtccttttcttcggtctttcttttgtgcctattgttatttctagttgccagtttttctagcagctgtctgcgacatacggagaaaaagaaacccaggaacaaacatgttgttctttgtgtcttgagatccttagccaatgttccttctcctctccacctttcaaagtcttaaattcttttatacataatgttcagagtttttagctgtacttagcaggaggaataaaaaaaagtaagtctactctatcttcctggaaaaagaaatctcttttaatagcctttattaatagctatattacatgtcaagcatcaggagaacaggaacaatactgaacttgaagttcagagaattgagttcaaatcccggctaacacgggagtttggagaaatcgtagttctgtcacttgttactcaagtgtcataattatttaacctcttagaacttcagcttccacatctataaatggaaacggcatcactttttcgcaagttggggatgattaagtaaaaactgtatacctgaaaacatctgacacaacacttgacacgtagtttgcactcactgactctgactctatgtttatcaaaatggttaagataaaaattgaatgattttagacccataacatttaaatgagctctgaattagtagttatttattctctatcttcttgtttcaaaataggctcccaccccaaattaagtcaggaaaatatgttgtaactaaacgcaacctgtaatttcagtgtcgagatgaatctatcttggtttctcacttcttgttctagctggagagtattctggtagttttcagcttcagaaactggagcccctagaccaaaatcatattctttggtggtaacctagtacaaagaatgggaaataatacagaggcattcagtttaaaacagctctgtgatttcttacatcaatacattttgaaaattgataatattcttagattttttttaaccatttcccaccagctaagaggatttcatcaaactttaccttcttaaaatttataaaactttttctgtgtgttgtccaaatggtactgaacatgcttttcaaagacattccctacactatccttttggtaatcatggttctacagaaatatggatcagtagcaaattaaagagtctacctctaggcttgtgttgtccaaaatagctattagtgagttacgtttgctgttgctactctatacaagaaaaaaggtttgcaattaatatcacaaagagtgaatttcctgaatatagaaataatccctagaaataaaaaagattaaaaaagtactctaatagaaaaattggcaaagaatgtgaacatttacagaaacggctcctaaatattaagatgttcaatctcaacctttagtgacacaaattaaaacactgagatacccccttttaaccatcacatggcaaagatcagtaacatggatatagcgtccttacgtatcaccggtgggagagtaaactgatacaatatttatggagaacaatggtataaaatctatcaacatgacaaatgcacatagcttctgttcaaataatttcatttctagaaatttatactacagctatatatatgtacacttatgcaaaataacaaatgttagagatttttcactttagcatactatacatactattctgcatcacgctattttacttgacaacatatcttagagactgtgtaacttaggaaaacaattttttctttccttgaatcaaggctaccattgtgttaaaaaagaatttgttatgagcatcttagatctttcctcaaaacacagctgctgttctccaaaatcctacctagggaattacagaatcaggatctccccagtcactgaccttatgatgcactctgtgtaacccagcacttagacaggccggcagatttatttcccttttttctcttctctaaacaagacacaactcttcttcattgcaacagttactgccccacctggaacctcaacattagatctcacagaatatttcaaattatgaagcatttaaacccccaggggctggactgaactcctaactaccatttcttacatggtttctgttaaaaatgtattgctagttataaacatgatttagaataacagaatgaaacgactcctcactagagcagtactgttcaatttttactgaatttaagaatcatctgggaatgttgtgtgaatgcagattcttatttacaggctgagatttgacatttctataaagctgcttggagatccctatttggttggtacagagaccacatgttgaatcatgctgtgctgtaatttctgatttatttgaatagcaaggatctatttaagtctaaacccatccaatattcagagtacttctgtaattttgtcccttcctacttctccaaatttacctcctacttgatacctccaagaatccctctatgaaagacaaactatgcaacacttaagggtctcaccctgtcacccaggttggcatgatcacggctcactgcagcctcgaaccccaggcccaagcaatcttctcaccctagcctcccaaatagctgggaacacaggcatgtgccaccacaattggctaattgttttaaattttgtagagtcagggtctccctatgctgccctggctggtctttaactcctgggctcaagagatcctcccgcctaggtctccctgggattacaggcatgagccactgcacccagccaacacattcttaatacatatattcaaaagtattttatcatctgttcaatgagccttgccctcactattttctccatttaacttaagacatttttaaggctcagctggaattccatattctccaggttttctctgtcttctccactgcataatgatcatctcttaattgatatttatatatatagaagaatttatgttctaaatttttctggatgtcttcctcacacatttattagactcttaagaacaagcaatgtccaaaaactctctctatccccattaacctgcacagttatttacgtaataaaaagtgtcaaaaaatttgttgaggttgataatgaagcagtgtgataaagcatacaaaattaaactttcttcctcctctttggtaaaccgaataaagtggggcttttgcaaaattacctatcaggcccagctaggaattaaaaatagcaagagaccacaagtccacctgacaatcctaaccaatcatgctggagttgctatcctccctccaccagctttgggggcaatatcactagaggaaagacacatcagtgtatctgaaattcccatgcctggtctgccagcttccctacctcaggccacataaatatcctcaaccttgctgcaatctcatcattagaatggaacttgtgctcctgtaccgttctcagagaaggcaagtgaaacaatgttccttcttaaaaaaaattattttttcttttttatgctatccctcccctaggcccccaactccctgacaggccctggtatatgatgttcccctccctgtgtccatgagttctcactgtttaactcccacttatgagtaagaacatgctgtgtttggttttctgttcttgtgttagtttgctgagaatgatggtttccagcttcatccatgtccctgcaaaggacatgaactcatccttcttaatggctgcacagtatccatggtgtatatgtgccacattttctttatctagtctatcattggtgggcatttaggttggttccaagtctttactattatgaacagtgctgcaataaacatacatgtgaatatgtctttagagtgacttataatcctttgggtatatacccagtaatgggattgctgtgtcaaatggtatttctgattctagatccctgaggaatcgccacactgtcttccacaaattagttgaatttacactcccaccaacagtgtaaaagcgttcctatttctccacaacttctccagcatctgctgtttcccgactttttaatgatcgccattcaaactggtatgagatggtatctcattgtggttttgatttgcatttctctaatgaccaatgatgagctttttttcatgtttgttcgctgcataaatgtcttcttttgagaagtgtctgttcatatcctttgcccactttttgatggggtcgtctgtttttttcttgtaaatttgtttaagttccttatagattctagatattaaccttttgtcagatgggtagattgcaaatattttctcccattctgtgtttcctgttcactctgatgatagtttcttttgctgtacagaagctctttagtttaattagatccatttgtcaattttggcttttcttgccattgcttttggtgttttagtcatgaagtctttgcccatgcctatgtcctaaatggtattgcctaggttttcttctagagttgttatggtcttatgttttatgtttaagtctttaatacatcttgagttaatttttgtataaggtgtaaggaaggggtctagtttcagttttctgcatatggctagccagttttcccaacatcatttatgaagtagagaatcctttccccattgcttgtttttgtcaggtttgtcaaagatcagatggttgtagatgtgtggcgttgtttctgaggcctctgttctgttccattggtatatatatattggtatatatctgttttggtaccagtaccatgctgttttgattactgtagccttgtagtatagtttgaagtcaggtagcatgatccctccagcttcgttctttttgcttaggattgtcttggctatatggggtcttttttggttccatgtgaaatttaaggaagttttttctaattttgtgaagaaagtagatggggacagcattgaatctataaaatactgtgggcagtatggccattttcacaatattgattcttctgatccatgagcatggaatgtttttccatttgtttgtgtcctctcttatttctttgagcagtggtttgtagttctccttgaagaggtccttcccatcacttgtaagttgtattcctaggtatgttattatttttgtagcaattgtgaatgggaggtcactcatgatttggctgtttgtctattactggtgtataggaatgcttctgatttctgcacattgattttgcatcctgagactttgctgaagttgcttatcagcttaaggagattttgggctaagacagtggggttttctaaatatacaatcatgtcatctgcaaacagagacaatttgactcctctcttcctatttgaataccccttatttctttctcttgcctgattgccctggccagaacttccaatactatattgaataggagtggtgagagagggcatccttgtcttgtgctggttttcaaagggaatgcttccaggttttgtccattcagtatgatattggctacaggtttctcataaatagctcttattattttgagatacattccatcgatacctagtttactgagagtttttagcatgaaggggtgttgaattttatcgaaggccttttctccatctattgagataatcatgtggtttttgtcattggttctgtttatgagatggattatgtttattgatttgcgtatgttgaaccatacaacttcatcccagggatgaagccgacttgatcatggtgaataagctttctgatgtgctgctggatttggtttgccagtattttattgaggattttcacatcgatgttcatcagaaatattggcctgaaattttttgctgttgttgtttccctgccaggttttggtatcaggatgatgctggactcataaaatgagttagggaggattccctcttttttctattgtttggaatagtttcagaaggaatggtaccagctcctctttgtacctctggtagaattcagctatgaatccatctaatcctgggctttttttttggttggtaggctattaattactgcctcaatttcagaacttgttattggtctattcaggaattcaacttcttcctggtttagtcctggaagggtatatacccttccaggaatttgtccatttcttctagattttctagtttatttgtgtagagacgtttatagtattctctgatggtagtttgtatttctgtgggatcagtggtaatatctcctttatcattttttattgtgtctatttgattcttattagtctggctagcggtctattttgtttatctattcaaaaaaccagctcctggattcattgattttttgaagggcttttcgtgtctctatctccttcagttctgctctgatcttagttacttcttatcttctgctagcttttgaatttgtttgctcttgcttctctagttcttttaatcatgatgttagggtgttgattttagatctttcctgctgtctcctgtgggcattcagtgctataaatttccctctacacactgctttagctgtgtcccagagattctggtatgttgtgtctttgttctcattggtttcaaagaacttaattctgccttaatttcgttatgtacccattatcattcaggagcagtttctatacagttgcgtgattttgagtgagtttcttaatcctgagttctaatttgattgcactgtggtctgcgagactgttatcatttccattcttttgcatttgctggggagtgttttacttcaattatgcggtcaattttagaataagtgtgatgtgttgctgagaagaatgtatattctgttgagttggggaagagagttctgtagatgtctgttaggtccggttggtccagtgctaagttcaagtcctgaatatccttgttaattttctgtctagttgatctaatattgccagtggggtgttaaagtctcccactattattctgtaggagtctaagtctctttgtaggtctctaagaacttgctttatgaatgagggtgccctgtattgggtgcatatatatttaggataattagctcttcttgttgcattgatcccttaaccattatgtaatgcccttctttgtcttgttttgatctttgttggtttaaagtctgttttatcagagactagaactgcaacccctgcttttttttgctttccatttgcttggtaaatactcctccatccctttattttgagcctatgtgtgtctttgcatatgagatgggtctcctgaatacaacacaacaatgggtcttgactctttatccaatttgccagtctgtgtcttttagttggggcatttagcccatttacatttaaggttaatattgttatgtttgaatttgatcctgtcattatgatgccagctggttattttgcccattagttgatgcagtttcttcatagtgttgatggtctttacaatttggtatgtttttgcagtggctggtatgtttttcatttccatgtttagtgcttccttcaggagctcttgtaagccaggtctggtggtgacaaaatatctcagcatttgcttatctgtaaaagattttatttctcctttgtttatgaagcttagtttggctggatatgaaattctgggttgaaaattcttttctttaagaatgttgaatactgacccccactctcttctggcttgtagggtttctgcagagagacccaatgttagtctgataggcttccctttgtgggtaacccaacctttctctctgtctgcccttaacattttctctttcatttcagccttggtgaatctgacgattatgtgtcttggggttgctcttctcgaggagtatctttgtggtgttctctgtatttcctgaattggaatgttggcctgccttgcttggttggggaagtcctcctggataatatcctgaggatatttccaacttggttccattctcgtcactttcagagtataccaatcaaaggtaggtctggtcttttcacatagtcccatatttcttggaggctttgtttgtttcttctcatccttttttctctaatcttgtcttcatgctttatttcattaagttgatcttcaatctcatagcctttcttccacttgattgattcagctattgatacttgtgtatgcttcaccaagttctcacgctgtgtttttcagctccaacaggtcatttatgttcttctctaaactggttattctagttagcaattcctctaacctttttaaaggttcttagcttccttgcattgggttagaacatgctcctatagctcagaggagcttgttattacccaccttctgaagcctacttctgtcaatttgtcaaactcattctctgtccagttttgctcctttgctggcgagcagttgtaatcctttagaggagaagaggcgttctggtttttgaaattttcagcctttttgtgctggtttttcctcatcttcatggatttatctgcctttggtgtttgatgttggtgacctgcagatggggtttctggggtttctgtgtggacgtcatttttgttgatattgatgctattccttttgttagttttccttctaacagtcaggcccctctgctgcaggtctgctggagtttgctggaggtccactccagaccctgtttgcctgagtatcaccagcaaacagcagaagctgcagaacagcaaagattgctgcctgtttcttcctctgaaagcttcgtcccagaggggcacccaccagatgccagccagggctctcctatatgagatgtctgttgactcctgctgggagatgtctcccagtcaggaggcatgggggtcagggacccacttgaggcagcagtctgtcccttagcagagcttgggcactctgctgctctcttcggagccagcaggcaggaacattcaagtctgctgaagctgcacccacagccaccccttcccccaggtgctctgtcccagggagataggagttttatctataagcccctgactggggctgctgcctttctttcagagatgccctgcccagagaggaggaatctagagaggcagtctggctacagcagcttagccaagctgtggtgagctccacccagttcgaacttcccaccagctttgtttacactcatttggaaatgcagaaatcacctgccttctgcattcatctcactgggagctgcagacagaatagaacagttcctatttggccatcttgccagccactaaaaaattatttttaatttattctttatttttttcaatgtgaagtctaaaataaggaagaacttttattctcaattaggaagtcacacagcagagtggttaatatcatgtattttggtatcagcctgcctacattcattatcctagttctgccacatcttagctgtgtgatcttgggcgacctggttacttctctgactatagcttcctcatttataaaacagggatgataataagagtatctgcattggctgggtgcagtggctcatgcccataatcccagcactttgggaggctgaggcgggcggatcacctgaggtcaggagtttgagacccacctggccaacatggtgaaaacccatctctactaaaaatacacaaattagctgggtgtggtggcaggcacctataatcccagctactcgagaggctgaggcaggagaatcacttgaacctgagaggtggaggttgcagtgagccaagattgcaccattgcactccagcctgggggacaagagcgagacttcgtaccaaaaaaaaaaaagggtctgcatcatagagttgcgtgaggagtaaatgaattaatatatgttttaactttagcacttagaatagtgcctggcacatgataagcactatatatattatttactattattactaattcctctcactgagtcaacttatttaattggctatcaagtcctactgctcttttcactaaaaattatctcagttacatttcttccatccctactatcactgttttagttcatgctttcagactgtagcagtcacatgtattcactttatatgtaaacttataaatagctagaataagaatgaaccagaaatatgtttctggggataaaaagatgtaaaacaaatagaatcttacaatttcaaccctaaatgaatctaggaaagtccagaacaaataaatcagaaattacaccacagcatgattactgctacatcagagtaatgcacacagatgctaaggtaacactgagaaagaagctacaaaaaaagtatttctgccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccatctcaaaaaaaaaaaaaaaaaaaaaaaaaaaaaaaaaaaaaaaaaaaaaagtatttctgacttctacttcttcaaaaaagacttaggatctactcttcattccaaaagaactatgaacatatcccttctggagcacttaatgcattatattacttttatgggatgtccacagccatggctactttaacgtgtctaaaacagacttcctttttttttttttttttgagacagtcgtgctctgtcacccaggctggagtgcagtggtatgatctcggctcactggaacctccacctcccaggttcaagcaattccctgcctcagcctcccaagtagctgggattacaggcacctgccaccatgcccagctaactttgtatttttagtagagatggggtttcaccatcttggccaggctggtgttaaactcctgacctcatgatccacccgcctcagcctcccaaactgttgggattacaggcgtgagccactgcacccggccaagactctgcctcttaatgtgatcaccttaggggttagaatttcaacctaaaaattttgtgaggacacagaaattcggactgaagccacacattagaggaacagaaagaaaaagctattgggcgaacaaagaagggagtactagatcttgtaagtgaagacaagggccaaatcatgtaaggccttacaaagtttggattttatttttaattgcagtgggaagccattggtgtatttttgagccaggatcatcttattataattttctttttcatttttttttccctctcccttctcccctcccacaggatctcattattttgaagtgattgatatgatatcagtgtggagaataggttgtagggagcaacagtggaagcggaaagatagcagggaatggttgcagtattttaggtgggagatgatggtgacttggaccagggaggtggtaacaaaaatatagagaagtggatggatttaggatatatatttgaaccaacaacatttgctaataaattagaagggatttattgcagtgagccgagatcgtgtcactgcactccagcctgggcaacagagtgagactccatgtcaaaaaaaaaaaaaaaaaggcacagccatgatgagttgcctgtatataataggccccagagagctcccttgccccttctaacatatgaggacagagtctgaaggtaccatctatgaaccaaaaaacctcagacattgattctgctggcaacttggatcttagaattcccagtctccagaactgtaagaattaaatttctgttgcttatatgttatttcattatagcagcctgaatggactaagatatttgccagtaacatttgacttcaggtcctctgctcttgcttttcctctctcaggaacactttctacccagcctttcacatggctatcttctcaccctcagctctttggctgaaatgtcagagggtcttccctgacttcttacctaaagtagcctctctcctagtcactctctcaaataagtgataagctatttgcacttatcactacttgaaattatatcatttgctgacttgtttactatctccccatactagaatataaaattcaagagctctaggcttttgtcttgtctctgttttatccctaatgccttaaaagtgcccagcacaaaggtgaaacgcaataaaacattttcaaaataagaaaatttaatgattcgaacaaagcagtttcaatggtgggtgaaaacaagtctgaaggggactaatgaatgaatagtaaagaaaaagaaatggaaaatgtaaacttcttttaggaagcatgattgtgagaggaagagaggtacaacaaaggtggaagacaaccaaggttgtggaaacgtcattatgggaagagaaaaacttgttccttaattctctttacataaggatcctctttcagaattaaaagtcctgcatcctctcctcagaaaaatgcaaatacacctttacaaacaatttcaggggatttaagactctataaggtccttggactccaggtgaagaagccctacagtacagaaacaatgaagattcctaaggcatgagttaatgttaattgatggagaaagacagctgaggtaataagaggaaacccagataaagatgtattgccccgacacaagaaagacaaaagcaaggacaggtgaagatttagacacttgtaatcccaataatcccaacactttgggaggccaaggccagaggatcacttgagcccaggaatttgagaccagcctggacaacatagtgagttcctgtatctacaaaaattaaaaaataaattagccaggcatagtggcatccacctgtggtcccagctacttgggaggctgagataggagaatcacttgagcccgggaggtcaaggctgcaatgagtcatgatcgcaccactgcactccagcctgagcgacagtgagatcatgtctcaaaaaaaaaaggtaagtgtcatggaaatctgaggaagtttctgtctggttgaattttaatttttcagtgaaacaggagctaagattatataataaaaagtatcatcggtgttgagcaaaatatgaagcacataatatgtattcaacaaattattgattttttgatagaatggaaaatactggagtacttcaatggaattctgaaatctggttccacaaaagcttactacagttgaggtgggtttttctttttaaaaatattgtctccaaaagtgtagacttatagacattgaagtagaaaggaactgcctcactaacagaaggatgtggaaaaccatacaagatttatgaataattctgagagagtattttatataataaaaataagtggataaatattttgggaaacaatcagcaaactaaatactgcgagcaacaataaagattaatcttaaaaaaaatgttgagtaaagaagcaagatgtaaatgaatacttagtacaattccattcgaagttcaaaaacaagccaaactgtaatgtgcatgttcacatacaatgatgtgaaacattaaggaaaatcaaggaagtggctatcttagaagtcaggagagtggctatctctggggagggaaagaaatatgtaatctgaaaaggtgataaatagtaatacctctaactgcctctgtgtatggaggacttcaaaaccaaatcgtcctaaacaaactagtctaagcaactcaaaaagaagacagaaaagatctcccagagaatctctacacctgattatattctgggctacaggcagtgatttttcttcagaaggtaaacagtacgcgagatattgtggaagctgccattaaataatgccaaagtttaggatttaaaattaatatttaattaatgtaccgtcctagttatttcccactaattaagactgaagagtttggctcattaatcaattaaaatacaaacaagaatctgtcttatcctggaagcagattcgaatgcgacatcctacttctataactaacctgtttttttctacttacaaacctattgttattctacttatgtccttacacgtaaacaaagtatacttgaaatgctgaacaccagtacagaaaattttaaacaaggaaatctcctaggatataaggtcctggaatggaagaaggaaaacgttgggacactataatctatgcaaactttcccgaagctgcgaaaaaaaaaaagtgaaaaaaaaccatatttctgtgagtttttaggtatcaagtccatgatcacctagttatccaatttaagtctcaaatagtttttcaacaaaagccagctttccctgcctttactgtgtataatttttactaaaattatctgagattttcatgcaaatgcctatgtaatctcagcctttcaccaccccaagtctagaaagaggctcagaaatgagcgatcgggagtcaggctgaactcccaaatctgtgacttccaaattcctcggctccaccagagcttccagagcgtttctaaactgaacagtctccccaacaaccaagcggagagctgcgggaggacgcgaagcagtgaccataggaactgggctcaaacctaacctcccaagaaacaggggcaactcgtgctgccgagcttccggccggcagctgtgcccgccgctgcccctcacagccgctcccgctgctagcgcccaactccgcccgccacggccccgcacccgccactcctgcccgcttgcagccgccttctcagagaccttccagtccagtagcagcactctccccaccccgcgcacctccgcagcttctacctggagctccgggtccctccccgggctcctcggcccgccgtcctgcccagagctcatccccgcgactgtcagctctcggcctcagcgggggatacaagaaccgcccactctccatcctccgcccctttctcctcccttcccacccccaaatcgtcctggccccgccccggcggatcggaggaaggacggagcccgcgggaaggaggagggggcggttagcgccagccagtgccgccgtggccccgccctcacgctctgtaccggagtggggctcgtcttccacctccccggcgccccagctttgcttccgtcccgctcgcccccaggcccggtgcgcacgcgtacctggctcgaccttccttctcgcggggtctacaagccgtgcgcgcgctcctacgcacggagcgacgcgtacgtctacctgcctgccttacagggcacctaggagggaccccttcctggcccatccgcgccgcgcaggcgcacgcccacgcagcgcctagacgcccgagccgagcgtcccgtctcctagtaaccagccgctagcccccttttccacgactcatttcttaatctctgcctgaggctgccgcacctggatggaacgcgcatgcgcaaggctgtctctcgcagccccgccttccctcagcttgaaacacctgctgcttcgcggcggtggctttgtgccacttttcccagggcttgggcatcattctggacccatgttcggtgaaccggttactctcagagctgctttcgggcgcagctcctgctgcagccagggcccgttttaagagaggcttccaggtccagccctcccgctgcagcctgcagggagcgagccggcctgtcccggtgagcgtgggcagcctggagtcaggggagcctggggaccacggccttggtcagctctgcacgatcagggctgaatcaggaagtggcagatctagcaacaaagtccagattcctgaccgatattccttctccacatgccagtccttttccaaatcccctcaccttaaagtgacaaatgagctttttagtgaaaaagaatgagcgctgcattcttctaccaattttttggagcccagaatgggggggaaaaaagtcttcttaatttttcttaatacctaccatgtcccttcttaaataactcaagagcttctggatgataatggtgactttatctccttttcctgcagatgacatagacactaggtttttacagcaattctctgatgaccttgatatggtagaacgctgtgtatttcaagagtaagctctcgtttgaggagactaacaattcctgttttcgccaggtgagtactcatttttccccccacaagatatcattggcagggataaacaacttttgtgtagaacaaatttagtcataaaaatacatttaatataaatgccatgtttttccaatgtcttttcatcgtgttattacatggtctcatattttgtcgcatttattttcagatatcatatactttgtaagtataattagataccaaaaaaaattaagtgtccctgttattttagattaagaggttagaggacacaaggagcacatatcctcggaaatgtaattttttaaatgcacaaaataacaaactgagaagttatgttagagggaataatgtataatctcatttcctcttcagatactaagattattttgaatacattatctagcattattaaaaacaaataggaaagaatgttctaagtttaaaactatcagctggagttgaagacttcgggggtggggagattattaatataggaagtaggaaagtacttcccttatagaaagaataagaaaagtttaagcacttatgtatgccacctagacggtactgaagattatttggaaagaatataaggaaatgatcattttaaggccaaaagagggtgaaaagattttccttttttttcctatcaagaactgttgactttctcccctaacctgagaaagtaaaaatttccttccctctgtggaaacccaaggggtagtgagtgtcccaccctgccccaactaaaccttttttttttttttttttttttttttgagacagagtctcactctgtcgcccaggctggagtgcagtggcacgatctcggctcactgcaacctccgcctcccgggttcatgccattctcctgcctcagcctcccaagtagctaggactacaggcgcccactactacgcccagctttttttttgtttgttttttgttttttgtatttttagtagagacagggtttcactgtgttagccaggatggtcttgatctcctgacctcatgatccacccgcctcagcctcccaaagtgctgggattacaggtgtgagccactgcgcccagactttttttttttttccttttttttaagacagagtctcactctgttgccctgtacccaggctggagtgcgttggcatgatctcagctcactgcaccctccacctttcaggttgaagcagttctcctgccttagccccttgagtagctgggaccacaggtatgtgccaccatgcccagctaatttttgtatgtttttgtagagatgcggtttcaccatgttgcccaggctggtcttgaactcctggactcaagtgatccacccacctcagcatcccaagtgctgggattatatgcatgagccactgtgcctggcccaggctaagccttatatagtaccctgtgcttgctctctcgtgacagacaccttctaaggtcttggttttctagtcccttaatttttccatcatttcaaaagcttcactacaaaaacctctgttattactattttttgttttgttttcactgtcctcttcctgatcccctcaaaaaaaaatctgggactccaattccatatgtgttaagccacttgatcttgttccacagctcactgatgctgtgttccttttttttgtttgtttttttgagatggagtctcgctttgtctcccaggctggagtgcagtggcgcgatctccgctcactggaagctctgcctcgcggcttcacgccattctcctgcctcagcctcccgagcagctgggactacaggcgcccaccaccacgcccggctaatttttttgtatttttagtagagacggggtttcactgtgttagccaggatgatctcgatctcctgacctcatgacctgcccgcctcggcctcccaaagtgctgggattacaggcatgagccaccgcgcccggcctgtgttccgttttttaaatcagagagtttcctccttatgccgaggcctgaaagttccaggcaatgtccattcatagggctcactttatttcctgtttctcaaggatcactctcccgaactgcctgttgtccaatatctaaaagccattgcttcatgtgttttgtgttttgatgctgaaagcaggcggggcacggtggctcatgcctgtaatccagctactcgggaggctgaggcaggagacttgcttgaacccgggaggcagaggttgcggtaagccgagatcgtgccatcgccctccagcctgggggacaagaacaaaactctgtctcaaaaaaaaaaaaaaaaaaaaaagatgctgaaagcatgaggataagtctggtctctgttactccatcatgactagcagcagaagtctgccattcttcacagttccaggccccatgtcactaactatcctcaagggatgtggtttgcaatgcaaaaattgcttcaggctgggggaactgtaagtgcaaaggtcctgaagcaggagaaggtttggcatagaatatgcttgaggaacagcaatggggtgataggtctggggtcgaataaggcaaagagacaggagagagtgcttgctagtagagttgtttgctacggctgtgcaacaatttaccacacacttggtgtctttaagcaacacaaatttattatcacacggttctggagatttacaagttcaaattgggtctcactgggctaaaatcaagatgtcaggcaggtctacattccttctggaggctctaggggaaaatcccctttcttgcctttccagcttctactggcagcccatgttccttggcttgtgatcccagtctatattcaacgccaaaaatggccagtcaagtcctcctcacattgcatcatggctaacacattctacctccctctttcacttctaaagactcttgtgtggcaggtgcggtgactcacacctataatcccagcattttgggaggccaaggcaggtggatcacttgaggtcaggagttcaagaccagcctgttcaacatggcaaaaccctgtctctccccaaaaatacaaaaattaactgatcgtggtggcaggcacctgtaatcccagctacttgggagctgaggcacgagaatcacttgaacccaggaggcggaggctgcagtcaccctagatcacaccactgcactccaacctgggcaacagagtgagactctgtcccaaaaagaaaaaaaaaaaagacccttgtgattacattagtaccacccaattaatccaggagaattttcccaccctcagagtcagctgattagcaaccttaattcccccttgccacataacataacatagtcccagcttctggggattaggacaaagacatctttgaagactattattctgcctaccacagctggggaccagatatgtagataatttttttctctgatatgggaagcaactagagtgtgttgagcagaggactgctgtgatctgggttttgttataaaaggttcaaaccagtccaggcatggtggcttacgccagtaatcccagcactttgggaagtgggaggattgcttgagtacaggcattcgagaccagcctgggcaacacagtgacaccctgtctctacaaaaaaaatgaattttaaaaattagccagatgtggccaggtacggtggctcatgctgtaatccaagcactttaggaggccaaggagggcagatcacttgaggtcaggaattcgagaccagcctggccaacatggcgaaacatcgtctctactaaaaatacaaaaattagccgggcatggtggcaggtgcctgtaatcccagctactcgggaggcctcagcaggagaatcatgtgaacccagaaaggcggaggttgcaatttctttgcaacttgaatttctctgattcctagttaattatctgtttgggattcctcaatctgtgaattatgtttttatatcctttgcccatttttctattgggttttctttttccttgctaatttctaggtgttctctttttattccagccattaaataccatcagctttggacacagaaaatatctccttccagtctcttatctatctttttgtttatatttttttcattgaatagaaattctcaattatgagtaatcaaactcactgttttcctcccttattgtttaagctttttagtcttgttcaagaaatctttcttcactccaaggtaacagatattttcttctattgcatttacagttctgccattcacatttaggtctttaatgcatttgcactccacttttttttctttttgagacggagtcttgctctgtcgcccaggctggagtgcaatggtatgatctcagctcactgcaacctccaccccctgggttcaagcgattctcctgcctcagcctcctgagtagctggaattacaggcacccgccaccacacctggctaatttttgtatttttagtagagacagagtttcaccatgttgatcaggctggtctcgaactcctgacctcgtgatccgcccacctcagcctcccaaagggctaggattacaggcgtgagccaccgcgcccagcctacttctgtgtttaagatcctgcttatgtccacatagttagccaatgttcacgataccatcatactaaacttagtctgttctatctcctttgtcttatagtgccacctgtgatatatgtgaagttcctgaaatacctaagtccaagttacagctctgtcatattctactgattatttgttcctgtacctgtacaaggttatttttattactttcactttgtggcatatctttttgttttttttaatttttttctgatagggatgaggtctccctatgttgcccaggctggtctcaaactgctggactcaagagatctttccaccttggcctcccaaagtgctggaattacaggcgtgagccattgtgcccagccgcgtagcctatcttaatatctagtaaagaaagccactttgttctttttctccagattgatttatctctttatgtacctttattcttacatatatattccagatttcttcttgaatggcaacctaaatgccagtccaaagaggcccccaatagacttgttcacccttcatgtcctcaactctggggaagttaaggtaagactcacagggccaagtctaccctattatacttggttcctcctcagtccttttattagattgaagtttaatgtgcaaattgataattatatgttaccattcttttacgtttgttgatttcaaatgccatgttttagagttttgtgttttttaaaacgttttttcaattttgtattttgaaaaagttttaaacctacagaaatgtaataataataatatgtagaacaactttttaagctttacctcctagatttaacagttgttagcattttgcatattttactgtctttctgtatctatgtatctatctatctattgctaaacaatttgagggcaagttgcagatacaattcttcacccctaactatttcagtatgtatttcctaagaacaaggacattgacttatataaccacaatacaattatcatattcatggcatttatcacattgatccaatattattatctaatattgtcccatatccaaatgtttcagttatctaagtaatgatctttgtagtacattccatccccttcccaattcaagagcattggttgcatctgaaataatgtatctttagcctcctttaatctgaaacagttcctcagcctctctgtgtctttcataacattgacatttttaggtagaagctatttgtttcatagaagatacttctgtttgggtttatctgattgtttcctcatgtttagattcaagttatgcatttgacaggagtatttcctttctaagaaaaagagaaaccaaatagaataaactcaattttattcatttgaaggcagtattagatattcctttgatgaggaagaaaaattcatcttcaagttccaaatctaaaaatcaaatatacccatatttcagaatttcatcagagatattaaaaaatttagctaagttgtatttgagtcccagaaagccaaatatatactatttacctaattgttatattaatatttgagtaagtactatatttaggctactacagtagacccaggactctgttttgttataaacactgatattcagtcacaaatatggataaacagggtttcaagatgattctttagaaatgttcagtcagtaattacagcttgatgagtatgaaattgtaaactatcaaagataccacagtaggtaaatattaaagacataatacattctaaaaagtgggtgaggctgagcgcagtggctcatgcttgtaatcctagcactttgggagctgaggtgggtggatcacctgaggtcaggggttcaagaccagcctggtcaacatggggaaaccccgtctctactaaaaatacaaacgttagagtttctgtttgggatgattaaaagttctggagatggatgaccatgatgtttgcacaaaaatgtaaatgtactcaatgtcattgaattgtacacttaaaagtgtttaaaatggtaaatgttatatatattttaccacaataaataaaatatagactggaaaaaaaataaataaaaataaaaataaaaatacaaacattagctgggcctggtggcgggcacctgtaatcccagctactcaggaggctgaggcaggaaaatcactttaacctgccgggtggaggtccagtgagccgagatcgcaccacttcactccagcctgggtgaaagggtgaaactccatctcaaaaaaaaaaaaaaaatgggtgagggatttcgatcgaagctgtggaatctgctccagatctcaggttgctactatagcatcttgggtagatcactcttctccagtaagccctgggctttctcaaaccttttctgtacaggaagcctgtcccttctgccatcctggtcaactctgcctaccaaattcctgcccatctttgaaagcgaaaccctaacctaggctcccctcctttgggaaacttcccaaggcctccctccatgctacatgatcatcttttttttttttttttttaagacggagtctcgctctgtcgcccaggctggagtgcagtggcgcgatctcggctcactgcaacctcagcctcccgggttcacaccattcttctgcctcagcctcccgagtagctgggactacaggtgcccgccaccacgcccggctaattcttggtatttttaatacagatggggtttcaccatattagccaggatggtctcgatctcctgacctcgtgatccacccacctcagcctcccaaagtgctgggattacaggtgtgagccactgcgctcggccgatcatctctttttacagactagacatccttaatcacaagtatcttttttttttttttttttttttttaagacagagtctcgctcttgtcgcccaggctggagtgcagtggtgcaatattggctcactgcaacctccgtcttccaggttcaagctattctcttgcctcagcctcctgaatagctgggatttcaggtgcatgccaccacacccagctaatttttgtatttttagcagagatggggtttcaccatgttggccaggctggtctctcaatcctaacctttggtgatccacccgcctcggcccccaaagtgctgggattacaggcgtgggccaccgcacccagccaatcacaagtatctttataggacatctttattttttacagaaaataaagtactagcagagtacttggccttcagtcgttatttctttagcccattagtaatgaataaagaggtttcgctagcaagaatgaaagaaaggactaagagaagctctactattttctgaaaggtgataaaacatacaatcagataaatttccttttaaaaagactttcaaataaatctttagaacctgcaaaccctcccacaaagaaaatgtaaacactgaaaggtaggaggcaattttactttatatttctagtatcaccacagcttttcattcaaacaaacattgccatgaagttagggaaattcctgctgcattcacttgttactttttttttttttttcagtaatcaagttgaagaaacacttccactacttaaaaaggtacctgcaaattactttcacatttgttcagctatcctaatgggattttcacttagtaaatctgctactcaggtatctgctatacatatggattcaaaagtggatgatcacttaatacgagggactgaaaaaagcaggttggaaccagcgactcagttatttcaaaacaccaagaaaataagattagaagacacaaatcaagaaaactttacaaggattgaagggactggcacaggatctctttctgggaaagccttgggttcagtggtatatgtcaaagaaagtgatggactagaaatgacagatgtggaatgaagcaatttgtacgtattaccaaagaaaccaaaaactgcctttgactaaggggggtgttgaaagagaacttaaccttattaggaaaccctgacaaaatgatggaagactattgccttattttgcactatttgtgaatcatcttacactgcatttttttatgatgcttattcaaaaggcagttgctttagggtgaaaaagccttccaagattcaaagcagatttctctggtattatattatatccttcttaaaaaccagagtttttaagtaacagtatttgaatggcatcaaaacattttcattttaatgtatttctttaacaagtggttaaaaaaagtgtccaagcagccgggcgcagtggctcacacctgtaatcccagcactttgggaggccaaggcgggtcaatcacctgaggtcaggagttcgcaaccagcctggccaatatggtgagaccccatctctactaaaaatgcaaaaagttagccaggcatggtggtgggcacctgtgatcccagctacctgggaggctgaggaaggagaatcgcttgaaccctggaggcggaggctgcactgagctgaggtcatgccattgtactccagcctgggcaacaagagcaaaactccgtctcaaaaaaaaaaaaaaaaaaaaaaaagtccaagcaatgtgacatccgtatttcacaatatttctggtgtatcagttttgtatgttacatttccattttgggattctgctttatgatactttactttcttacattttgcatttttgttctgtaaaagatcactgccaataaactgcaaaagaccaataaattgcatatcttcagaaggatttcacattttaaatcgtgcctttaaaactgctttttccccccacatagaatccattttagagttagaaaagtgttctttccaagtgttaatagtttgtcttgcagatggtaccattttatgtcaccaatatttaatatgagaaaaaacaacctgtttaaaaaccttgttttgtatatcagttatgaaaatatctggtagttggaaatctctttaatattcattttaaaagaggaaagggcatcttttccggggggaagctatattttattaatcagaaaaatactaaacaaatgtgtttgtagggaatattgagagtgaaaaacaattgttgaatgggacataagccaaaaagacaatgctttttattatttacagaacgtaattctttagaagagaaaaaaaatacataaatcattcatttgttcacctagcctggcactgtgcttggtgctggagatacagtagtgaataaaatagccagtgccttgtagagttttgtgcctgtctactaggaaagacaggagattatacagtaattatataagatgcaaattgtgatatgccatgaagaaacgtatagcattcagagggacataacacaacacaagacataccacataaaactgattttttttaagatggtctcactctgttgcccaggctggagtgcagtggagcgatcatagctcagtgcagtgtcgaattcctgttcttaagcgatcttcctgcctcagcctcctagtagctaggattacaggcatgtgccaccatacccagcatgtttttgtatttttttagagacagagtcttacaatgttacccagactggtctcaaactcctggcctcaggtgatcctcccactgggccataaacttgattttaacgtgggaaatgggaaagcgtatctcaggacatttttgaaagcaagttgattaagaaagtaaagaaacagaatggctactccatagagcagcctctgaggacatttatagcttttgcagtgacatggttgtctaagtgaatgatggtgatggtcataaaagtggagagaaggggatagagtccaggtgaagtctgacaggatgtagtcatggtttggaagcggaaagtgaggaagaagaaagggcttctggcaaaaaaggctttagcctttatgcatgcaggatccctggggggaaagagtgagttcaggagcatggcttttagacttaccaggtttacaaggcagttgtatctatggaactaaaaaatataaattttgaagttgtatacagaaatggtacttagagccatagaatgaatgaaattgcttaaggaaaatgtagtgtgagataaagatctgaggaactccaacatttagggctgactagatcagggtagctggcaaaggggactgcggagttggcagtgaggctggaggaaaacctggcaaaagggactgaggagttgacagggtaatgtcaaagttgtccacaggaatctccaggttgaggtagtcaaatgaacacttagatgaatactgaaaagtccagtggatctagcaatatgaatgtcacccgtgaccttagcaaaagcacttttgctggaataatggggaaaagccattttggagtacgttgaaacaatgaatgggaagtgagaaagtagatactggatgtatagcagtttttccaagaagcttggctcagaagggtagcagacaggatgacaagtggaaagagaaatgaggtcactggaggattgttaaagagtacagcatgtttgagtgtcacttgaaaggttccagtggagaagctgaagaagtaggtaaaggtaagaataaccaagggacagaagtcctggagcagggaggagggaatgggattctttaaaacctcttcatcaagaaactaggaaaaaaaaccaaagttgtaccatctcagatttcagagaaagggaatttagaaggaagtaatataagcaaagagcaacaatattctgtgactgtttttaataataactaggaaaattcctagtgcagttaactctgaacaaaattcattcccacctgcataatacaagatagacttactcagagtgaccttggtaaaaggtgtgataataaagaaaggaggtgtcattatgtcttcattgtagctttatatgaagccctggtcatttaccgtatcagcatcagcaaactgaacactgaatgattcttactccaagaggcaagtcttagtggtttctattttaactgaaggagagattaatttctgtgcaaggttgaaaaaggtgaccacaaattctttgggcttctttcatcaagaggtgaagtccattaccccacgccttaactctgggctggctttgttgttgttttggccaatagaatatggctgaggcgctgcttccaagattaggcctgaattgagatgccctagcagccaggcagcacctgccagagcatgaataaggctatcttggaccgcccagcgtagccaacctgtgctgaatgaagccacatgaatatgcccaggagaaactagcagaagaatcacccaccttgcccacgttagagatataaaccactatttgaggcagtttgttatgcagcaaaacttagccgaaactattaccttgctaccttgactgctggtgtaatttcccatctcatggagtcacagagttttcttgccaactgcagtgagttggcaaatgggaatgatcagtagcctcagtgtgttttctgatccactccatcctgtattatcatctgcgaataccgtttttcctttaaatgcaatgtgtctttcaaagctgacttgaatttctcacctttcgagttacctgccatttggactcacttatttggaggagatatgtaaagacccagcgtaatacctgtatgctcaataaaaagtatttgctggtactccttcctgcccgtcgtgtgacctgactgctctgggcttctgggggctccccctaaactcgctccacgaaatgacccctccaacctggcacgcccgctctcctaccttcgcccagggctggccgttatctctgtgctgtcacgcggggaagtcccatctgaactggggccttatgaccttcggtacttttattcgaacgtagcctgcgtccctgcctggaacctggttcccgccctgaaggacccttacttagcactcctgcgggctgccgggaccccacggctccgcaggcggagagactaggcgcgatccctgcgcgcccctccttctcttgcgcttcagggggccggccctcagggggcggggcagcatcgcgcgcaaggcctgccggttgctcggggtcgtatgacgcacttttccagctcgagccctcacgaggccgtgggtacgaccggaagccgcaggtgggtgaagcggaaacgcttcaaaccgggatgttgcgggccgtagcgcgtgggcggccgtggggtcttgggcgcgcgcggtgtttctggcggtgggtcaggacttgcgggtcgcctccgccggtgttgaagcctcttgtgtgcacactttctcctcagcacttgggacgacctaatttcactgttaggaacggttgatcccgaacacaggagggagggtaaatatcgtaaaacatgttggacgctagctgtgtgcacgccccctgggagccaaaagggcgaagtaaaacatgcacacgaccgtaatgagattctgagtaagttgtatatcattagagaggggacaaaataatagggtcttggcgaggtcttatgaagaagctgcgcctgcctagaaagatagatgggattgtgctgttttcgctttcagttcagtgatggggagccgtgtttggcagtgcagaggtagcgaagtgtcccaagaacatggaaggtaaggaagtcttccgaggaaaaacttcaaaaaattagtcattaaagggtgagagtagaaagattcaaagtgattttgaaggaacaaaatttaaccagaacttcaaaggcttgacactatcccaacgactgtgaaatatcctgaaataccgtgcattactcagtcggggtctgatccgctactggagcatagaataaaaaaagaggggcacacctgtgccagatgaatccacgccttctctaggggagagagggtatcccggcttaagagcaggggctctcctgagttaaggaagtgtcttccccagagcccattccgtcagacgttcatatcatgtaactcagtccttttctgattatgtattcaccaagcaaacttaagagttggcttgtcaccagacctacagtgaataattgcacaggctcatctgaatatctgatagatggtctatagttctctttgtaaatcaataagctggcagtcagggatttttggacatccctttgttttcactttttctcactctgtgtgattttttcttatctttcggggttcaactgaaatgtcacatcctcactgaggtctgtttattggtttacgtgttcaggtgcttagaacagcttcttgcatcttttctcacatgatgcctttttaatgaggcttagcctaacaaccctatttaaaattgcaatgtaagttttctcacatacacagttacaatcctccctttatcagctctacatttttttttaatagactgaatctcgctctgttgcccagcccatctcggcccactgaaacctccacctcccgggttcaagcgattctcctgcctcagcctcccgagtagctgagattacaggcgcctgccaccacgcccaggtaatttttgtatttttggtagagacggggtttcaccatgttggccaggctggtctcaaactcctgacctcaggtgatctgtccaccttggcctcccaaagtgctgggattacaggtgtgaaccacctcgcccggccatctactttttttaatagccctccttatcacctttattcatttgactcactgatgattcccaagtgctaagaacaatgtctgtcatgtaattgatgaaaactttgttgaattaatacctttgttgtgttttattcacactgtatatacaatacctggatgaagagagatatttttagcactattaaaatacatgcattggctcaatacatgaattggatcaattctggaaccctaacaagatcacatttttgaccaaagtcaatatcttggactatagttaatttatcaaggtaaatgccactttgatgtgtcttggttaggaatctttgttcacttgagggaatacatggtatatgataggaacagtaagcacagaatagagatgggaaagggagaaccctgtcataacagttaacatttcatatttgccaaacatgaatggcttatgcatattaacacatttaattctctcaaccattttatgacgtctgaggccactgaagcagctagaggttaaaccacttccctaaagtcattagtaagtggcagagccaggattaaaaatttaagtccttaactactttgccatcctgccacactctgcacatgcagacaagagtaagagccttaatcttgggaaaagatatttcacaagatctttgacaatttccatatccacagacaccatccagcttattagtgaccaccactcctatttgttactttctcctttaaggctgcccctacctgaactctggatcccagtaccatcactttctcaaggacctcccttctccagtgttgccctctcttgactcccctaccagcatctaaacatgctcagatctattgcatcttaagtcctctcctaactccacattcctttctacctactgccctagcttttccacttcacaactagaataccctcattgtatccaccttgggcctcctatttactcagtacatctggttcttaccaagatcactgataaccttcttgatactgtttaatagatccttttcaaccctcatcttatttgctcaatctttggcatttggcactgttgaccatcttgtctccttgaagcttccataatagcatatttaaaatttttctgccttttcttctatcctcagcttcctttgggagctctccctccttcttctgtatgtccgttaaatgttgctgctcttcagtcttatgtcgcaggcccttaaatcttctcactgaaccaccttcctgtggcctcagttaccatccattgagctctgtgccgttggccgctagttcaacagtcaaaatgaaccaattatcttaaccccatacttcctcttcctataaaatctgtcctaggaaatttcacctctttgccaggccagaaatcagggcataatattaataaaatagttagcacatattgtgtactttcttcagtgccaggcactcttctaaccactttatatgtattagctcatcagactcagcctgataatatgagatgagtcctgtcattatccacatattagataacaaatctgagacatagaaaagtaatctgccttaggtcattcaactgataaaggatagagttgggatttgaatgagggcactctggtttgagcttgtaatcattatatcataaaggacatgatgcttgacttctctttctctcaccctaattcaacctattgccaagtattgtacattctccatgcttaaaatctctaggcggtgtccctgaagtataaatccaaagccttcatgcctgtaatccgagtgctttaggaggccaaggcaggaggactgcttgagcccaggagtttgagaccagcctggacaacaaagtgagattcatctctacaaaaaaaaaaaaaaaaaaaaaatagccaggcgtggtggcacatgctggctaaagggggaggattgcttgagcccaggaggtcggggctgcagtgagccgtgatcacaccactgcactccatcctgggcaataaagttcaagcatttcacttggatttaaggttctttataatctaacatctacttctcttgccttcttattaactccccattcttgtattcctaataaccagccagtagaattaaattatttgcatgggtcctatctccttttccactaagctgttgcacattgttagaattcttttctttatcccttttatgtctcagcttcaatgtcacatccactaattagagcattagatggcgctctactgtacttaacacctatcacagcatttaggacactgtattttaattattgccttacttgttttttagtatctcccactagattgtggaggtacttgtttcttgaaggcaaggacaggttcaccttcttttctttttttttcttttagacggagtcttgctctgtcgcccaggctggagtgtagtggcacgatctcggctcactgcaagctccgcctcccgggttcacaccactcttctgcctcagcctccagagctgctgggactacaggcgcccgccaccatgcccggctaattttttgtatttttagtagagacggggtttcactgtgttagccaggatggtctcaatctcctgacctcgtgatccgcctgcctcggcctcccagagctgctggtactacaggcacctgccaccatgcccggctaattttttgtatttttagtagagacggggtttcactgtgttagccaggatggtctcgatctcctgacctcgtgatccgcctgcctcggcctcccagagtcctgggattacaggcatgagccactgcgcccggccagttcaccttcttaatgtcactcatatccatccccttctctctctctctctctcctaccgtactttaggccctcattatctctagcatggacaactgccttagtccattaactgttccccctgtccctagtccatcctttatttaatccatactcaaccctgcagaggcagattcgtataacagctgagttaacacttcctgcttaacacttcagtggatcttagctgccttttaaaaagtccaaatattttggttcattacatgaatttatctcctcccattttctatctccttattaccttgtacctagtaggaactccataaatacttgttgaatgaatatggtactgtgtcaaagtcagtcaagcagaaccaagaacaaagaggttaaccaaagtaatgcagtctcggttgcgaggcttcctaggacagtatagccataggcttaagtggaagtcgaagactagtagtgtaactctttctcttaggagggaatccccaaacataccttactattagatgactctttgtctttgcatatgcctggaatatgctcctcgacctggcaaacttatcagatttggtgactcagttcaagtattccttcctctattaaacctctccacacctttctagacagaatgtaaactgattcaactttttgtaggttagtttataaactacaacaagagtgatgaaaatatgaagactctttaatctagaattgtacttctaagatattacttaactaaatgatttggggccaggtgtagtggcccatgcctataatcccagcactttgggaggctgaggcaggaggatcactgaagcccaggagttcaagatcaacctaggcaacgtagggagacccccatctctacaaaaaatttaaaaattagccaggcatggtggcgcatacctgtagtcccagctgcttcagaggctgagatgtggagattgcttgagcccaggaggtcgaggctgcagtgagacaattacagagtgataccctgtcttaaaaataaaaaataaaaaagcctagctacctagttatgaactttctttatttagaaccaaactcttaacctcaagttatacactttaataatccattctattcccagttcttcaacctgaaggaaaattatattctaagaaatagaattggaatagaatgatttaagaccataagtaatcaaaatacttcattttcatagctagtattttcaaccttttgctgcctaatatttcattagcaatggtaacatgaataatgtggaaagcatccaaacatagtgaatttattcttagcctttgtatataaacctgcatactcccagttgcctctctctctgacctcaagggttcatcctaagttaatattgatctaaataaaagttatgctgccagtaaatcatatatcccaaagtcaaacaggaaattatttttaaagtgttataaagacataatgaaagctttccacggaaatgttcatgaacacatcgttgataaccagaaaaactagaagccacctaaaattacagactaagagactgagtaaacttgttaacaatggaatattaaacagtcattaaagctgatgcaaaatagatttaatgggccaacgcggtggctcatgcctgtaatcccagcactttgggaggctgaggcgggcagatcacctgaggtcaggagttccaagaccagcatggccaacatggtgaaaccccatgcctactaaaaatacaaaatttagccacacgtggtggcaggcgtctgttatcccagtgaggtaggagaatcgcctgaacctgggaggcggaggttgcggtgagccaagatcacgccacagcattccagcctgggtgacagggcgagactccgtctcaaaaaaaaaaaaaaaaaaaaaaaaaaaaaaaaaaaaaaaaatatatatatatatatatatatatatatatatatatatatatatatagattgaatgtcgaatgaaataatagtatggggagggaaatgtgtgtgcgtatacatgcttagaaataaaatgggtttacaccaaaatgttaattgtgattaggactatcaatgcttttatttttttcttcttgcttgtctgtattttctcatttttctcgatgaacatttgttacttgtgaattcaacataatttggctttaagatataggtaatgtggctgagtgcagtggctcatgcctgtaatcccagcactttgggaggccaaggtgggaggactgcttgagcccaggagtttgagaccagcctgggcaacatggtgaaatcctgtctgtaagagaaaaaaaaaagatatattacataatgtatttgcagcagacttattgtttgaaaactgtgaaattatttcaactgaaattatttgaaatttgtcttcatttatttcttttgaatacttggttatagcattgctaaagactaattgtaaagctaaaagccaaaagcaactgcactggatactttaagtttggattaaataaccgataattgatagttagaaaatagaatttaatgttccttttctcgatgaattaatttgtttgtcttccatttttaaaagcatgctgatcccattttcaatgaagaattgcttccagttactttgtaactgccaggtcccagcagctggctttaaaaaaacagtaaaaaatgggctcattttacagtcaatttccaatgatgtctatcaaaatctggctgtggaagactggatccatgaccatatgaatctagaaggcaaaccaattctattcttttggcagaattctccctctgttgtaattggtaggcatcaaaatccttggcaggaatgtaacctgaatctaatgagagaagaaggtataaaactggctcggagaagaagtggaggaggaacagtctaccatgatatgggtaatatcaatttgactttctttacaaccaaaaaaaagtatgatagaatggaaaatctgaaattaattgtgagagctctgaatgctgtccaaccccagctggatgtgcaggctaccaaaagatttgaccttttacttgatggacagtttaaaatctcaggaacagcttctaagatcggccggactactgcctatcaccattgcactttattatgtagtactgatgggacgttcttgtcttctttgctaaagagcccttaccaagggatcaggagcaatgccactgctagcataccttccttagtgaaaaatcttttggaaaaggatcccactctgacctgtgaagtactaatgaatgctgttgctacagagtatgctgcttatcatcaaattgataatcacattcacctaataaacccaacggatgagacactgtttcctggaataaatagcaaagccaaagaactgcaaacttgggagtggatatatggcaaaactccaaagtttagtataaatacttcctttcatgtgttatatgaacagtcacacttggaaattaaagtattcatagacataaagaatggaagaattgaaatttgtaatattgaagcacctgatcattggttgccattggaaatacgtgacaaattaaattcaagtcttattggcagtaagttttgcccaactgaaactaccatgctaacaaatatattacttagaacatgtccacaagaccacaaactaaacagtaaatggaatattctctgtgaaaaaattaagggaataatgtgattccaagtaaatgtcttaatacagtttcaattagaaaataaaatgtctcatacttgcacattgtatgtcaaaaaaaaacctagtctcttttagtaacgtcaaaaaaaaaaaacaaaacacaacaacctagtctctttcagtaacttctccccatctgaaattctttatcacctatccctatctgtgtatttcttctgacctctaggatcctctttcttctctttcttccttcatttattttattttatttatttcatttatttattttgagacagagactcactctcacccaggctggagtgcagtggtgcgatcttggcccactgcaacctttacctcctgagttcaagtgatcctcatgcctcagcctcccgagtagtgggactacagggttttgtcaccatgcccagctaattttttctatttttaatagagacagggtttcactgtgttggccaggctggtctcaaactcttggcctcaagtgatccgccgacctcagcctcccaaagtgctgggattacaggtgtgagccaccatgccctgtctgttcattgattttaatacctggcatgtatttatatttcagctgctgctgcttttactctcttggggctatatataatattggacactctgacctcagacttagttctctgtttttcttatctctcggagatataacccagatttcttgccacctctcctcatatctcaaactctaaaattctcccttttagttatattttcttatctttctactctcccactaaaaatcaaggctgttgcacttttctaagctcttaacccttccctaatctctccttgcatcatttcccttctatcccagcctgaaatttactttatgctttactttcttaccagtattctcatttgcttctctcctttgaccttctaccatagccactttttaattttagtctaaacaattgattttctactctttttggcaggtgatgctggggggaaagatcatataatcattgaagattagcccaatttgatatttataattttcaacttatgtatctttctgctggtgtcagatttaattcatctctggttgagttcccctcattcttaaggggaatgtttccactcttctcaagctcagaatttcactactcttaccttgtcacaaaccttgattcataatttggtgagagttgaggccttcagaaatgagtccctccagcccccatggcccccctcctcccctctccactccctttctcttctttcaagacagggtcttaccctcacccaggctggagtgcagtggcatgctcataggtcactacagccttgaactgggctcaagtgatcctgttgcctcaggttctggagtagccggaactacagatgctcaacaccatgcccagctccctctgtttatgagttattttcttttaatatatctcagtagttccaggccccatcctttttttatttttaggaagagcaggcatggacacagggttttgcctacaattgattatctcagactgggggtagggtgagtgattttatttttcaaggtgttcttgggacaaacatgattggcagtttagcaggtttaatgggcaggtccttttgttatttaaaagcaatattaaataccaagtaaacacaactttgaagagattactcatgaacatttcacacttgttaccacctatgaaaattattttttgagaaaggttaaaaatcctgatatgatgtgctttggtgcagtaataccatgtttctccagagagaggatatcatcaggcaaagggtgttaagggcttcgagttccaaattggaaatttgaccaagtaacccctgaaacatatggactcaaggtatgttttgcagtggtttccccagaactttctgaatgtttgcatatggggatgagagaggagtcaaaatggcatacacacacacacacacacacacacacacacacacacacacacatatatatatagtcttatttttttgagacagagtctcattctgtcacctaggctggaatacagaggtatgatctcagctcactgcaactgctgcctagtgggttcaagtgatcttcctgtctcagcctcccaagtagctggaactacaggcttgcaccaccacgcctggctaatttttgtattttgagtgcagacaggtttcactatgttggccaggctgttcttgaactcctgacctcaggtgatctgcctgcctcagcctcccagagtcctgagattacaggtgtgagccactgcacctggcctttactcctagatttcttatgagattggatggatgggagtatacatggggagtagggcagtgtatatcaaaagttaggttggggtgtattatatttgaaatgtttgtgtgcttctgagatgtcatacaggcagttgaataactccaaggagaagtcttggcttaatttataaatttgagggctgaccgcatataaatagtattttaagtcatgagaatgaataattttagacttttataattcatctaaagtttaaattttaaactattaaatattcagcatctgggtccccttatatgtttgcggacttctccacctggtaggaggtagagcctacttccttctatggaaacaaaagtttactatactctttgctggccttccttgaagctcagacgtgggcacatgacttaagctgtgccaatcagatgcaactgctccatattttgaattagacactagtgatgcagaacatctggaatgatgagaacccttctctggaagtagcgacaggggcctgaatttctggggtaatgaaggcagtgaggctagcgtgatagtttccaagccagtgatatcagtggtgtaggctactgcatccagcccttgcatcagtgtcagcaggggtgtcatctgattagttctgggtagtgattctagatgtgatttttcactccaaaacctctgtgtctcagtctatagctcaactacctactattcttataataaaccccttttttgcttatatcaggtaggagcagtttttgttgttttttactaagaacacttaaccatgtaatcacttagggaaagagtgtgaattaaaaaaaaaaaaaagaggttactacctagtacctagcttgggagaacttcggtatttaaaatgtaagaagaatggaggaagagagtgtgtttcatgaaagtcaagagtttcaagaagggagtagccaactgggtcaaatgcttctgaaaggtcacatagtacgagagtttaaaagtgcccattgaatatggtagtacagagatcactgttgaccttagcaaaaacgatttcagtggagtacctggggcagtcgccagactgaagtgagttaaagcaaataggtggtgaggaaataagaaaaaaaaaaaaaaaaacatacagagaacactctttgaagaaatttttcatgaagaatgaaaaaatagggtggcatctggctcgagatgtgtgtactaataggaatgatgcagtacagcaggagagattgctctaaggcccaagtccttgtggaggctaaaggaggtcagatcaaggtcactgctaaaaatctggccatcatccttatatattaggaatactgactctaattttataaatttgatctctcatttttttaacttagcttatgtttccttttactcaagttttgtatatttacatgaccaagtcttttgctcttaagagttctggggctttctgttatactcagttcattaagtggggttttaaatatatatatatatatatatatatatatatatatatataaatttttcattaattagctctgtaatacgtttagatttctttgtatggtgtcaacatcattacagaaaaatttctttatgcggagtaagacagaggccttaatgttattttttccaaccatttgttgagctctttctccactaacttaaaatgtcacctttattacatattaaatactcattcatacacaatttctctctttcaaatgtgtttctggactcttttattctatcccactgatttatttgcccatgcctatgcccatacatttttaagaaaattattgtagctatgtctttatagctggtcaagcaagtctcctggtgttactctcttttgtcatttaatttataaattaagttagagagaactgacattaagtcttcccattcaggaatacaatttgtctttctagttaccctaattttcttttatgtccctccataaagcttatagttgttcatatagttcttaacacatttcttgatatatttaagctgtacctggtaggcttctggtgctctaattagatctggggatagaactccaaatatctagaatggatagcatgtctgtagactcttttctttaaatatcactatgtcttagccaggatttttatagaagttggataaaagttaattgcacagggttgtggattgctaattctccatagtaacgattcatatgctttagaaatcagaattgttattttaacatgaaggtaaagaggcctaacacatgttcttaccttaattaagagccactccatttccacgtggcatcgggtactgggcaagataagcaaagatactctgcagaaaggaacttcggatcaggccaacacttgttcaagtgttttcctgagaccctgaatttccatatgatacagcttagtaaattagtttgagtctaaaatttttcagattcagtattatcagcacctgaacctgaaaagatttaaaaaaaaatcaggaactgttctggaagcccttcctggccttttatgccagctccatcttgtacctaccagctgtcccacaaaaggaaaacagtgtccaaggcttgcccaagaccactctgtccaaccttgttcccatggtctctacctttggtcctctacactgttttaactctgttgaatagtcctcagatgtgacatttatatgtgcactctccaatactgaacactggtactatagttttcctcttacatatgttagcttagctgggtttttttatttgtttctttttttattttgagatggagttttactcttgttgcccaggctggagtgcaatggcatgatctccgctcaccgcagcctccacctccagggttcaagcaattctcctgcctcagcctcccaagtagctggaattacaggcatgcgccaccacggctggctaattttgtatttttaataaagacggggtttctccatgttggccacgctggtctcaaactcctgacctcaggtgatccgcctgcctttgcctcccaaagtgctgggattacaggcgtgagccactgtgcccagccagcatgttctttgagctgtggaccgcccactacctctagcatacaacccctcttcagcctgtctccatggaatctattctgtctccaaccacacaactggcatctggatgaaaagcttacccagaacagttgattctaagctgcaaggctttacaaatgtgccagccaaagtgaatgagctgcaaaatgcatttggataactgaatgggttgatttgccttcatggagttaggtaatactgcacaactgcatgatggtaaatgtttaccaaagacaattctcttaattgtaacaaaattaacattttactttcctgtttattagaccccaagcccatctgtctcttttttttcttttgagacagggtctggctctgtcacccaggctagagtgcagtggtgcagtctcagctcactgcagcctcaacctcctaggctcaagtgatccttccacctcagcctcccaagtagctaggactataggcacatgccaccatgcccggctaattttttttttttttttttttttttttttttttctgatacaggttgcccaagctccatctgtctctttaaaagcactctaatccatggtgtctttccctcctggacttaaaactcccacaggcaaaattaagatctaattcatcttcctaatagatgcttattatttgttgacatgctcccgcagccaagtaacagagaagctggtaaaatgtttaaattagctgtattacttgaaagaaacattgtaaatctgctgagtaatatatttacaaaaatatttaggattgttcccacaactgaatgatggatccataaattagtagaaatataaaagtttattgttaaattcatacattataaaagtgatcttttaaaaaaaatccaatattcacttaaagtagacataatacaaattaggctaccacccatcatatattttttgtatgcttcttatgaaaaatgtctactgttgtttcatgacatggtcttaaatcaaaatcacaatatccaagggaaaaacgactctaagaagagaagaaaagagtatcattaaaaatgatacaaaaacagtgctacacatttactcataagattatatcctacctgtggtttcttaaaataatcaagtccccttccaatcttaatcatccatccattgttgaacctgttgaaattagtatatagtattatattcaagacatttaagtcagactattaataaagctgtagtgtattaagtgtcagcaaaatttccccctaacaaagcaaaccacttcctccagtggcatgagttgaatcaaacctggggttcattatgagctgtgtccacaatgaaaacagtcatagaaacaatcagttgatttaattatctgatagtttaatcttgaatttcagcttgttgataaaactttttcgtgttctgctaacaagtggtggcaaagtgtattcagggaaactggtggtgtttcaagagttcccctacctagagatggggaatgtgcaggaggagccctggaccctgacctctgctttaactacagcagctgcattttcatctgttttgcatatttagtttgtgattaagtttttattaaaactgagtgcccttgctataaacataaccactgtgctaaacaaaaggaagatatcactaaaataactgcatattctgttttcttatagactcagcaaattgtcatgcctactagaatatttaataacccctaagaagtaaagccacattaagtaaatattaagttcactagaaaataaattatcctaatatcataacactatatatacagttgagtagacagaaaagtgttctctttttctatatgacacagaacatgtaaatactattccattaggaaatattaaactcacacacaaaacacttggcttactttgtcaaaaagaaagccaagtgttttttttcttctcaaaagtgaaaaagtactaaatggagttttatttgaattttaaatatttataaattattaaatatttataggcaattatataaaacatttacaaaaattttaagtatatatcaactgcataaaaattaaaacattattgtagactaacctaatttctcggtcatgtattgaagaagagtattgaacttccaacagcactccgtgactcctgagtgactcttctatttcttgcaggcctctactttgctgcacttgctcaatgccctgttaatagcaaaaatacgattatctgccgcagttattattactatcttaaattatccctaagctatacaatctatatcacaggtggattaagatggaaatgttctatactagtttcaatgtctattatctcaaaaaaacaaccaatgtgaggtagtttaaagagcaattatttttatcaaaatcatctttttttctaatgtgaacataactccatcctgtctccttaaatgtagtttagaatagttttaatcatccaggtggagctgactgcttttgaaatcaatcgtagaaatcataattatttagaagcattcttattttaagtcaaaaccaagatagagatgcccactaccatatcatatcatgctaccatcccccagatataataattggtaaagaaacaaaattgttcatagtgcagacagtgtgattgcctcctagaatatccaagagactaaactaacaaactatttgaataagtgcatttagcaaagtggccaaatacaaaatcagcatcctaaaatcaataactttttttatgacatgttatgcatactgttagataataagttaattcccaaggaaacaaatctagctgaagcactgcatctgtgttctccttgactggactacatcttgtaactgaataaagttaataagaaagagtaagtgctttcaggtacctacttcatccagagaggtgagaaggtgaatagtttttactttacatggtctcttaataagcatctcacaaaatcgaagaaagttatacagctaaaagacattagaatggattattactaatttagtacattgaatatgatatttcattatattttagtatgttcacatacctgatgagtatgtctaatataaggatcttctatccaaacttctgtaactgtctcattaaggtattcgcgaaaaagtgactcataactgaaacctgttgcattctcttctattttaatttgcttgtgatattttccatctataaaacacaggcttcaacagtaaaaccagtgaccattttttttttacacattttatattttatatagagtgattaatcagcatcagatacatattaatttttttaacttattcagcaaatacttattgaatgcctactaaatatcatatacattgcaggatgttacacgtacaaaggtatttaaggcaaaccactccattagtgatttctgccttcacagaggctaggcaagggggaaaatctagaggtttcctggaacaggtccttgagcaagatcctatagaccaggcagtttgttgaagggagtagtgtatatataaaggtatccaataactccctgtcgccatgggtagcaccacatactgaaactcagtggctatctggtcctcctcttcagacttgtctttttatgtcttgcaatctaataactaaagtgagtattaaacatgaatgcagggcagagcgcggtagctcacgcctgtaatcccagcattttgggaggccaaggtaggtagatcatttgaggtcaggagttcgagaccagcctggccaacatggtgaaaccccagctctactaaaaatataaaaagtagccaggcatgatgtcaggtgcctgtagtcccaactacctggggggctgaggcaggagaatcacttgaacccaggtggatgttgcagtgagctgagatcatgccaccgcactccagcctgggcaacagagcaagactctgccttaaaaaaaaaaaaaaaaattaatgcagtataatatgaagcttcaaagtctttcttggcacgtgtacagttttaaacagaaatttatagtacttcttaataagctaaagactgggatgtcacaggatcaagaggatagatctattgcttttgttcattcaaaatgaatattgaaaaagttatcagaaacctttaaggttttaaaaaaatatgacccctggctgggcatggtggctcacacttgtaatcccagcactttgggaggctgaggcgggaggatcacctgaggtcaggagttagagaccagcctgaccaatatggcaaaacctcaactctactaaaaatacaaaaatgagccaggcttggcggcgggtgcctgtagtcccagctactcgggaggctgggacagaagaattgcttgaacccagcaggcagaggttgcagtaagcagagatcgcgccactgcactccagcctgggcgacacagcgagactccgtctaaaaaaaaaaaaaaaaaccctaatggtagcccctaaattatactttacactttgtttaaaaatcagtagtttggattctgttccaaatatttccacatagataacattggcaactatgccttattttttaagccaagatagccgtatagaggttaatttaattccatgtactcaaaaccacaatgctggaggtactatatttcatcaatgttttggagtaaaatttcattctaaatttcaaatcggggctaaggaaacataactttattcccactgaacaaaggagctcagtggggggtccccagggtatgtactgatacaggatagtaggaagagatggggaaaggggtgtagaaagtatagagaggaagaaaagctggggcctgggggcactggcttttgagggcagcagtacctttggctatagaaagcagcaagtatgcactcaggtaagggtggaaatggccatttacagacatttgtaaactggatgcttaggagtagggaactaataatagggaacaatacctacctgacctctaatcattaggaatgcttaactcctgaggtgttttgattcacaacaaaatctgagagaaatcccaggagtttctttagcttctttcatgattttggtcatttcataaagggaaatataaataaaatacacaatttacattcagtattccctgtagtatttcttaacatagggtccacacataagcttcatagggatttgtgaaccccttaaaaatggcatggaacattctccagtaagtatagctttcatgagatgttcaaaggggtgtctgatattcccacccccaactaaaaacaaaagccaaaacaaacaaacaaacaaaaaattaagaacaactcctgtatgggagtggaaatacagattaaatcctgtaagctcccagggacaactggtccagaccacacagagctccaaagggcaggagccagaaacattgggtgaatggacagtcacagttgtttatggatgcattttctaaaacaacctctttaccttctttttcttggtccaagtacttctttatgttttccgctctgtccatgtatttggaaattttttctctgagattacatctcttagtattatctttggtacctacaaatttaaaaatatatattatcaagtatcaaaatagtttttctatttaatttgggcattattttcagtttctcaagttttctacaaatttcctatcctctagtatggcttgcctcagtcctcaaacacacacaataaactcaaatttggcttgaacatacaagaccttcatatttacacgaagcgtgatgcagcttggtttaggagtgggagctcttgacactatgtctcatctctgggacatcaaatctggtgggatgaaaggtggctcattacatgtcaaactcatgtctgagcactattttatcctaactacccacaagtttgaaatttttgcataattaaaagtagcaaaaaatatttatcttccacaaaaccagctactcttccagacctccccattatagttaatgcacatttttccagctaccacaaaaatgttatttttgaatatacatgatcataaagttttacccaaccacccctcctcccaaatcagtcaacaaatcacttcttgttccttcccttttttcctttcaacatcgcttatattttccataaataatctcattttttgtttgtttgttttgagacggaatctcgctctgtcgcccaggctggagtgcagtggcatgatctcggctctctgcaacctccacctcccgggttcaagcaattctcctgtcttagactcctgagtagctgggactacaggcgcccaccactatgcctggctagtttttgtatttttagtagagactgggtttcaccatgttggtcaggctggtctcgaactcctgacctcaagtgatcctcctgcctcggcctcccaaagtgctgggattacaggcgtgagccaccgtgcccggcccatttttgtatttttagtagagacggcgtttcaccatattggttaggctggtctccgactcctgatctcaggtgatccgcccacctcggcctcccaaagtgctgggattacaggcgtgagccacactgcccagccaataatttcattttaatctctcattttaaaaaacattttgagttaattttttatatttacagaaaagttgcaaaaatggtacagataacctccttcacctagattctcttaatgttaacatatcacaaaccatactacaagtatcagagctaggaaattaacactgaaacaatactatgaacttatctacaaaccttatttgaatttcaccaattttcccactaatgaaagtttgctttctggtccaggatcccatattgcatttagttatgtgtccttagtctcctccaatctgtgttagttccttaatctttctctgccttctatgtccttgacatttaggaataatattggtcagttatttttgcagaatgtctctcattttggacagtctgatgttttctcatcattagacttggtttatgcatttttggcaagaaaatcacagaagtgatgtgccttgctcagtgggtacatgatgttgatgtgtcttactgctgatgatattaactgaccatttggtaaaggtgtagttcagatttctccactgtaaaatcactattttctcttttgtaatttgtaagtaccttatggaaagatatcctgcttcccatcactctttctcccactaattttagcatctgttgatggtccttgcctgcaacaactatgactgtgatgtttgcaaaatggtggttttctatttccgtcattccttctcaatctatttattcaattaaatagtatgggctcagggatatttattttactctatgagttataatccaatactatcattttcctgctcaaattttatcagctttggctttgacatctccttcatgttagttcctgtgtccttttgtcaagcccgcatcgctattatgtccttacattttgattcaggatttttttgtttcattttgtttcgctgagacacagtctggctctgtcgcccaggctggagtgcagtgacatgatctcggctcactgcaacctctgcctcccaggcacaaggaatcctcccacctcagcctcccaagtagctgagactacaggcacacattactatgcctggctagtttttgtatttcttttctattttctgtagagatggggtatcaccatgttgcccaggctagtctcgaactcctgggctcaggcaatccgcctgccttggccttccgaagtgctgggattacaggcatgagccaccatgcacagccacaagatgttttaaaccaaatttgtccaactcttgcatgtggcccaggacagctctgaatgaggcccaacacaaattcataaactttttttttttttttgagacggagtctcgctgtgttgcccaggctggaggcgcaatctcggcttactgcaacctccgcctcccaggttcaagcgattctcctgcctcagcctccggagtagctgggattataggcgcccgccaccacacccggctaattttttgtatttttagtagagacagggtttcgccatgttggtcaggctggtcttgaactcctgacctcaagcaatccacccgcctggggctcccaaagtgctgggattacaggcgtgagccaccacacctggccattcgtaaactttcttaaaacattatgaggggtgtgtgtatgtgtgcgtgtgtgtgtgcgcgtgtgtgtgtgttttagctcatcagctgtcgttagtgttagtgtattttacatgtaacccaagacaattatttttccaatgtggcccagggaagccaaaagatttgttaaaactcatcttgtttattttttgccccagccctgaaatacccttttccaaggagcctcggtcacttttattgaagaatggcattgagaaaccaaattctgggtgccagctgtgttcattgctgctgggggagtcccaccactacttctagaccctctcagtcaatacagctaggaggtatatgtaggcttactaacacatacatctatatatacatacatctatatgtatttgtttctgtccatctatataaatattaaaaaccatgagttcatgctgataactttgattccacagagctcattctagctttcccccatccctctcctgcccaaataaaagcaaaacacaacctttcctcaaccttgctagactttaaattatgtagtagttcagtcttagtcattgtccttgatcagctggcagtgtctcacacatagacccatccttcaatcattacgctacagtttctcaggcttggacccttacagccatctttgattcccattaaccttactcccatatctaatcatgtgccagtgccccctccttatcttaatactggtatcatctccctggttcattcaggcccttatcatgcctcatctttttaaaaaggttttattaattttaattggcacataataattatacatattaatggggtacaatgtgatgttttgatacatgtatacattgtgtaatgatcaaatcagggtaattaggatatctgtcatcttaaatatttattgtttctttgtggtaagaacattgaaaatccttcattctagctatgttgaaacatacaacacattattaactctagtcaccctattgtgtaataagacaccagaatttattcctcttatttaactgtaaatttttttttttaagagagggtttcaccatgttggccaggctggtctcgaactcctgacctcaagtgatccacccacctcagtctcccaaagtactgggattgcaggcgtgagccactgcacctggcatctaactgtaattttgtaccctttgaccaacctctccccattcctcctacccactgcccttcccagcttctggtaaccactattctactctctacttctatgatattaacttttttagattccacatatgagttagatcatgtggtatttgtctttctgtgtctggcttatttcacttaacaatttcctacaagtttgtccatgtcacaaatgacaggatttcattttttatggctgaacagtactctactgtatatatgtgccatattttctttattcatctgctgatagacacttgggttgattccctatcttagctattatgaatagtgctgcagtaagcttgggagtacaaatatctcttcaacataatgatttcatttcctttggatatatacccagtagtgggatcaatggatcatatggtagttctctttttaattttttgaggaatctccatactgttttctataatggctatacacacctcttattttgattccagcaggagctccttaattggtctgcttaacttcagtctctacaggttaatgtctactttacatccttgccatattcagtcctttattcaagaaatatttattgagaactaacaacatgcccagcactgttctaagtgctgtggatacagcagttcgtaaaacagacaaaattctcttctattgttcaagtaggaagagaacaataaaaataaattggcaaaacatgtatattagattgaggtaagtgctattaaataaaataatgaaggaggacagggagtgctgggatggggttataattttacactggaggtctgggaaagcctcacaaagaaggtggtatttgtgtaaaggcctgaaataggagagagagtgtgccatgcaaataaatatctgtgagaaaagagcacattcctgaaagagacaagccctgaaatgcaactccaattatgttactcctttgtaaaaaccttaaatggtttctccttgcctgtggaataagttaaaatctcctggtagtcaaggccatcctcaatgtgatccaagcccctatctacctttaaactttacttctcactcttcctcttcagatacatgctcaaccaaactacttatttcgtaagacagcacaggaatttgaagactcttagatgaatttctgacttctgaaattatttttcctccaaagccccaatcaaactccacctctacctttccaccctcacatgacctttaactgtttaaatcctcattgcgtttatctatagatatctctctcctggcacttattccctgtattagcgctatttgcattttggtcttaacccatctatgtgacatcattgtctctgtaacctctacgggatcagtgaagcaccctagagcagaactgtgattctcctgcttcagattcctagtgcagccaaaacttgagcagtgttccacctgaccaacacagtacaccatctctcttttgggattcagtataccagagtcgttggggccttgggctccgactgtgactctaccacctcctagtggcagaacttgaaagcgaacaatactttttatgctgtaaaacgagaataccatcaactcctacttgatagggcaattggtacggatgaaacgagatcatgcttttaatgttttctgcaatgcctggcactcagcactgaaacgtgatatctatgcttattgctgttgtcactgtcatcattatcatcaaataatgccccaggcaaggtagagtttacagttattttttcttttttttgagacggagtcttgttctattggcagactggagtgcagtggcgcgatctcggctcactgcaacctccgcctcccggattcaagcaattctcctgcctcagcctcccaagtggctgggactacaggtgcgtgccaccatgcccggctaatttttgtattttcagtagagacggggtttcaccatgttggccaggatggtctcgatctcttgacctcatgatccacctgcctcggcctcccaaaaaagtgctgggattacaggagtgagccaccgcgcccggccggtagagtttgtagttctgaccaaagcaccaaaccataaagggctcccctctgctgccccaaagcttctgtaacactttaattataagaagcttaaactagaaagaacagagggagcttagtccagaccgggagtgtcgggggttggggagcaggagctgatcttatcaatttaatacataaatattgagtgtctactgtgagccagggttgtgctgggtgttaaggaatatttgggtatttctcaacattgaataatacgaaaagtctcacttgtctcctccacaaccctgcgcatttctcacaccgaacctcatccgtttaagaaaaacttttcttcttctaccgctacataattttactttggcttgctttaaatgcaaatgtttaaacagaaaattaaaaataatcgtataataaacacccttattacccatcaccgaaatttttaaaattagcatttttgctcaaatagagcttcgatttttaagaaatttttgcttaaggaaaattaactaaagacatcatagcatctctttctaaaacactttggtctgcatctctaaaaattaaggaaagttttggaaaaaaaatcatattgcctaagaaaataattttaatgccccccaatctatattcaaacttttctaatagatccaaaaatgtcttttaaagttcgtacaaacccaggtcctatcaaagcttatatattacattgcgttatatcttatatctcttaagtcttttaaaatctagactagtagcctccccaccttttctaggtaacatcaatctattaaagatctaaaagaaagcggcccagttgtcctatagaatatcccaccttctgtatttaactgcttcttcgtggtgtggaaaaatcatttttaactctttcacttcaccccagacacagcaggaaccagctccttttcctcaggtcctccccgccttggctcattgctcacctttcagaacctgcaggagcagatcaatcccctcttggtaacacaccagagcctgcggataccgcgactccgaatctagttctactgcccgctttagcacagtggctgcagctgtgctctgcgggtcctgcctcagcccggacttcgccataattctggaagttctcctccgcctcaacccaggatgaagttgagcgggtctgctgcgcttccgggaagtggtcatgtgatacccaggcgcctgcgctctctttctagggactttcctgagtgggagggatttcgccggaacaaaaatgcctcagtttggaggtcgcgctcactgcgacggcaggctttgagtgtagcacttggtagttcttcctctgctctgcttcccttcggaggaaaatttcaggctgaaggtttagcgggtgccggtgagtggggaatgagtggcggagagtgcggcattcttcgcaaggtgtatccgggaaccctctgcagatcctaattgattttccctattgcgtactgaattggccggttacggcaacctaaatgggtctgcccctgatcccgtcacattggctcccgtaaggccattggcctgcaggatccccccgtttcccaatttgcaggatccagggccacgcggctttttgtgcccagactcttggagctcaagaacggagccgccgaggctggacagcttgggaaagggaacccaagcagcattttctgtgctgctgctttattcataacttagggttgccactgggtattaaggttgcttttttttttttttaatgaagacagaaaattgcctttatctttgtattgcttcattttataatgcaaacatccaagagttggcagttagaatatttgccattttattaaaactgtgatttgttaccattttgatcgagacctaccaaaagctgtttgttctgccctttttgccaagaggcagtaatgagggctgcctactgcttgttaggcactaggagttcagagaagagacacgcttccagctttcagagatctctggtatctctgcaagagtgattccatgttttgcatttcagaagtgtttttccccctttaataattgtatacattgtcggtttagaaaaagaaatcgatttttaacattcctgttgcatgcatgctcattgtaaaaagacaaaagaactatcggtcgctgggggggagaagggggaggaaaaacgccttttttcatacccccaggggtatgttaacgtttttctgacaaccttccagagtttttctgtgattacacacgttcacagacatttaaaaaaatagaaatgggatcatacttctcctgtgatgcctgatattttcctgttttacagaagacagcgtaattgtttcagggtccaggagttacgtgcctaattattaacagtaacttttactttattaaaacgtattccttgccgggcgtggtggctcacgcctgtaatctcagcactttcggaggccgaggcgggaggatcacgaggtcaggagatcgagaccatcctggctaacacggtgaaaccccgtctctactaaaaatacaaaaaattagccgggcgtccgggcgggcgcctgtagtcccagctactggggaggccgaggcaggagaatggcgtgaacccgggaggcggagcttgcagtgaacccagatcgtgccactgcactccagcctgggcgacagagcgagactccgtctcaaaaaaataaataagataaaataaacgtattctttgagtcaaacgtggtgacacacacctagctccaattactgggaaaattgaggattgcttgaggctgagttcaataccagaaacatagcgagactctgtctctaaaaacttgtaacttttgactatcacaccttcagaagtctgtaaatatttaaacttcagttattctgcaaaaatatattatatgtctgctatagggcagataccgctttacacagatgtttgggatacttctatgaatataacagacccaaaacaacaaaatctaaaaacccttttcctatggaattagcgtgctattgaatgtacatgcactaaacaacaaaacctaacagataattaagttacgttagaagataagcacgatagaaagcagtgaagaggaattgggagtgttgacagttggggtatgggtgaaaatgttaaatgatgtgatctgggttgacctcattgaaaaggtgagatttgacccaaaaattgaaaaagataaggaaattagccatgtaaatatcaggatcattccaggagagggaatggtcagtcaaagggagcatgcctgcttgactagttctagatcaaacaaggggggcagcatgtctggtgattgagcaagagagtaattggagatggagtcctggaggtggggaaggttggtagtgctgtactacaaagacatgagagggtgagggttaagaattagagttgggggtggtggcccatgcttgtaaccccagcactttgggagcccaggcgggcggatcacctgaggtcaggagttcaagagcagcctagccaacatggtgaaaccccgtctccactaaaaatacaaaaattagctggacgtggtggcaggtgcctctgatcccagctactcagcaggctgaggcaggataatcggttgaacccaggaggcggaggttgcagtgagccaagattgggccactgcactccagcctgggtgacaaagcgagactctgtctcaaaaaaaaaaaaaaaattgattttcactgtgatcaaaatggacaagcattggaggttttaattttttcataaataaactttatttttgaatagttttagattttcaaagaagttgtgaagatggtatggagtttctgtatatgctacactgtttccccctttcatgtttggtatacctgtgtacagttgatgaaccaatattgatacgttattaaagtccatactttatttagatttacttagtttttgccaaatgtccttttgctattccaggatcccatccaggataccacattacatttaatggtcatgacttcttccttaggctcctcttaactgtgacagtttctcagactttccttgtttttgatatcattgacagttttgaggcagttaggtgtttgggaagatactggaagagagtacctacataaattatttggaattcttctgaatgggatatttgttctttctcattaacttattcacctatttatattagtatgaatttagggttatttatttatttattttggtttggattataagccagtaatactttgttacttattttgttgctgaaattgttccagctttgggtacagttgactgcagtgtcactttgacataccccatcgttatgttttttccagtagttcctttctagcattacaaagtgctccagacataatcagccatttctcaaaggagcactggttccttttattaaagaatgcagccaagatctgggcactgggtgtgctccttgccactgagtgctagtgctttaagtcctctcagctaacagagctagcccatgtatatatgcatatctgtaattacttctatatccctcaatagctatattaagctaaacatgagttccatttccaatctagtatataaggatcattgtagccttcccctcttgcttatatgtaacctcccacttcaacagtgagaatcctggctctctggaagatttttgagcagagtgacatgatctaagatttaatgagatgatttattgctgatatacaaaaaagatattaggggaattggaatggaagcagaagtccagttaggattttgttgagatctaagtgatcagaaagattttttaaagtgtgaagctaagtatgttggattaagtacctaaccttgatacgaggaagtctggtaaaataatttagcattagataggttcagttgctgaggaatgtttctgaggtctggctgtcttcaggagatgtcttgcgttgattctcacagttccgttgctttatccacatcacaggaaagacttgcagaacttgaatgagctagaatctgcgggacactgaattacaacacttagcctattttagtgtgttagagcagaggtctccaaaccccaggccttagacccagaccatttgctggcccattaggaaccagatggcacagcaggaggtgagctgtggttgagtgagcattaccacctgagctccaccacctgtcagagcagtccaacattagattctcataggagcgtgaacgctactgtgaactgtgcatgcaagggatctagattgcatgctccttataagaatctaatgcctgatgatctgaggtgaacagtttcatccggaaaccttcccttccacccctccctatctgtggaaaaattgtcttccatgaaactggtccagtgtcagaaaggttggggactgcagttttaagagtattcttattagctttgtagtaatttaataataataaaagctactatttattgagggcttcccacatgccaggtactgttttaggtgctttgtagaataactcatttgcaagacaggtattttctttcttttctgggggaaaaattgtaacgcacgaattaagtaacctgtccgagatatacatgtagttcatgaacttaatctttctgctatcagtataagtcagtatagtaggctacagttgttttgtgtgtaattaaataaatatgacctttttaggttatagaagcaatgcgtgtgcattgagaatagtttaaaaagtacaaacaagcaaaaaaaattctactttttaacagaaaggtgttatgatttagtgaaaatgcacttgcctaggaattaggagaatggggttccagaccacaaactttattgatagctggatgcacttggataagttattgaactttctggaattcatgatcctcattcataaagtaaggatgtgggcagtcagttctaattataggagttggaatttcttcagtcccttctagctctttaattttctgtgattctatggcaaagcattctttatctgccttcattgttgaagaagacactttaaatgatagtaattttgtggaatcaatctaggactgactcatttgatgaaagtgggatgtggctaatgtgtataattactacctgtggttgaataaaacatttataaattaattcgtgcccttattatattaaaataaccaataattttactgttaagtttacaattaatttgctgcttagttttttaatactagagaaggggaaacctgttcatttccaagacatagttgactgatgggtctacttcctacttcccacagcctctaaagagagcaatcactacacttatggctgggattttgcgcttagtagttcaatggcccccaggcagactacaggtaagtgtttcttttcaagaatttgtcttttctaccccttatgaattttttttttaatcattacaaggcaagctaagttcttttttttatttttttgagacgaagtctctctctgtcacccaggctggagtgcagtggcacaatctgggctcactgtagtctctgcctccctgattcaagcaattctcctgcctcagcctcctgagtagctgggactacaggtgtctgccactatgcctggctaatttttgtatttttcatatagtcgggggtttcaccatattggccaggctggtctccaactcctgaccttgtgatccacctgccccggccacccaaaattaagttatttcaccagttccttttcgaaatggtttagatattgagagttaatcttgtttatgtatggtttttctgctgttttatccctaaagatctagaatcaaaaaagatctttttctggaaaacatgccaataaaaaatggctgtcattgattccccttggtctgtcttaatcttaaagttttaggttgtttttccccttagattatggaaggagtgcattttcaataataaaatattagaaaaatatagaaaatcagaaggaagagaaataatctgtaagagaccctcagtgttagtattttcatgtgtctccttctaggcttgcttttagaaagtgcagtggtgctgcctaatctgctcataagggccagagcctagatgagcctattgacctgctcctggctgcagaggacaacaatgtaaggggctttgtatatattaccttaacctcagattaatcctgtgaggtcaatatgagttcctttttagagctgaggaaactgaccctctgagagagtaagtgtctcatgtctcacagctggtaggcagcagaactcagcccagtgcctgtcttctagtggtttatgccatctctgcaatgcaggaaatgctgggagggaatgatgggaatgactgttgcccattcccacagcagtatcctggtatgaaaggttggcagtgaatcctttttcttcagcagcctgagagaaatgggattggaggaatgtagagcaggaacaagaggtaggaactaggagtgatgacattgttagaactaggagggaaactagaaactcattttggatttcttttgtattgtcttgttaaatgtgagttattgcacattgtctagagcaagagttgataaactatggcctttaggccaaattcagcctcccacctatttttgtaaataacagttttattgaaaaatatccacacccggctgggcgcggtggctcacgcttgtaatcccagcacgttgggaggccaaggtggacggatcacgaggtcaggagatcgagaccatcctggctaacacggtgaaaccctatctctactaaaaatacaaaaaaaaattagctggacgtggtggtgggcgcctgtagtcccagctattcagaaggctgaggcaagagaatggcgtgaacccaggaggcagaggttgcagtgagccgagattgcgccagtgcagtccagcctgggtgacagagcgagactccgtctcaaaaaaaaaaaaagaaaagtttgcatattgtctgactgcttttaccctgtgatggccaagctgagttttggcaatggagactacatagctctagagctggaaatgtttactatctggtcctttacagaaaacggttaccaatccgtggtctaaaagtatatttatatgcttttagctttatattatgttagtgcttagatgggatgcgttcactcagctagggagctaagatatacctttaataattatagggtaggttggaacagacttctgttacctaaagattggtgggtatggatttctctactgacagaattctaaaaaacaaatgatttatatcatattttagactgtgacaaaaggtgtggagtctcttatttgtacagattggattcgtcacaaattcaccagatcaagaattccagaaaaagtaagaacaaagtttgatttttttaatgttagtgttgttttaaaaaatgttttaagtggtacccgtttttgtaatattggaagattttatgttaaattatatgtggatgtaggtgatggtacagagtttaaagcatagtgggatttatgtgaatggtgatcataaaaataaaactgttctgtcacttgtgtcactggccttcacagtaatgggtttttattatttcagtctacttattcctgcttgtggtttgtacatgtgtgttggtatcaccattgtcctgagaaagcagtgggtcttcctactcaggctctcactgtgtcactcttcattttcactttccgtatcgatcattgttactttggatctttcagctttttctatttcatttctgtgtacctatcattcttttagataatattgactaagcccgccattgatttttgtttaaaatttttttttaaagagagttttgctttgttgcccaggctggagtgcagtggtgcaatctcatctcactgcaacctccgtctcccgggttcaaacagtttttgtgcctcagcctccagagtatctgggaccacaggcccgtgccaccacacccggctaatttttgtatttttagtagagatggggtttcatcatgttgcccaggctggtcttgcactactgatctcaagtgatccacccgccttggcctcccaaagtgctgggattacaggcgcctggcctgtttttatttgttttttaattaatagtctttatttcttaaagcagttttaggtttgcagaaacattgattgggaagtatggagagttcctatgtgctccctccgcccagcatatacagtgtcccccacaactgatgaaccaacgggacacagtattattaactaaataccatagtttacactagtgttcagtcttcatgttgtgaagttctatgggttttgacaaatgcataatgtcatgtatccactattacagtattatacagaatagtttcactgccctaagtatcacctgtggttcacctatttatccttcccaactcctaacccctggcaagcactgatctttttattatctccatagttttgccttttctagaatgtaatatagctgaaatcatatggtatgtagccctttcaaactggcttctttctcttagcaatatacctgtaaggttcctccatgtctttttgtggcttgcttgcttattttttattgctgaataatatcccattgcatagacatacacagtttatgtgtgcattcatctatggaaaaacatcttggttgcttctagttttggacagtaatgaacaaagctgctataaacattcatgtatagatttttgtgtggacataaatttccaactcatgagttaaatacctggagcataattgctggattgtatggtaaagactacatttagctttgtaaagcctgggttttttgtttatttgttttgggtggggggttcctaatattttttattgtggtaaaatacacatataacatttaccatcttaaccacttttaagtgtgctattcaatggcattaagtacattgacactgttgtgcaactattacaaccatccatctccagaactcttttcatcttgcaaaactgaaactctatatccactaaataataactgccaacctaggcaacataaggagacccagtctctaccaaaaaaaaaaaaaaaattagatgggtgttgtggtacacacctgtagtcctagctactcaggaggctgagcggggaggattgctcaatctcaagaggttaaggctgcagtgacctataattgtgccactgcactccagcctggacaacagagcaagatcctgtctcaaaaattaataataatagtaactccccattttcccctctccctagcttctggtgactaccattctccattgattttcttaaaagataaaacagtattaccattgactactttgatacctttaatgtgcttggtgttcttttatcagaaatctcatccaggtacaatggttcacacctgtattcctagcattttgggaggctgaggcaggaggatcttttgagtccaggaattcaagaccagcctgggcaacatagtgagactctgtatctacaaaaaatttaaaaattagctaggtgtggtggtgcatgcctgcaggcccaactgctcaggaggctgagatgagaggatcactttagcaagaggtcaagggtgtagtgagccatgatcggatcagtgcactccagcctgggcaacagagtgagaccttgtctcaaaacaaaataaagaaatcttttttatttttcaagtcattgtctttccactgctattctttccacaactatattgtcttatatctttccatgtttcttactctgtatttctggaaggatagatacaaatgttggcattcatttaaaatatgcaaggctaggcacaggcaggagaataacacacactggggcctgtagggggcgagtggagggagaccaccaggaaaaatagctaatgcatactgggcttcatacctaggtgatgggttgataagtgtagcaaatagtgcagcagattgccatggcacatgtttacctatgtaacaaacctgcacatcctatatttgtgccctggaactttaaataaaataaatgtgcaaggcagtggttttgatcatcaactgtgataaatatgaaaacctttaaacctcatgaaaatagcccctgactatctttttttttttttttggagacggagtctcgctctgtctccaggctggagtgtggtggcgtggtctcggctcactgcaacctccatctcccgggttcaagcaattctcctgcctcagcctcccaagtagctgggattacaggcatgtgccaccacacccagctaatttttgtatttttagtagagacagggtttcaccatgctggccaggatggtcttgatctcctgacctcgtgatccaccccccttggcctcccaaagtgctggaattacaggcgtgagcaaccacgcctggcccctgcctatcgtctgaacttattcctgtattctcctgtattctcaactggtttctagacattgctacttggataacttataggtatttcaagttcatatccaaaattcaactcatcttactttccctccaaacaaccaaataaaaaagagggtgcgtctcttgtattagttatgtcagttaatgctaccatcctctatctaatttcccagactaaagacatctgaatcaagctcagcctccctcttcttcacccaacacaaatccatctatattactgcccagagttcccatatcagtcctttttctgttacagctactgtagttcaggctcttaaaccatggtcataagtgcctcctaactgggtttccttgtatcagtctctatccccagttggttttattcttaggtaagagttttctttgcaaatctcatagaaacatggtcctattggttctaaccttcattaactctgtatccccagcggtaatttctaaaggctcaacatagtcgcgcatagtttaacttcatcctctgcattacttttcgtgcttttttctatattagccaccctgaaccacttgcctttccaaaatattttgtgctccttcatactgttcctttaaatattctcacctttctttagtgcacctaccccttcctctgatctccaccatccttctcatcctaatctcttcaaaatctctagaaaaatataaacaagcaaaactcaccaaaaaatactcttaatcttacccaccccgagataactgctgccaactccttccacatccttctttgttgtatgttttatttttttcttttagactagtcaagtgcagtaatgaggaggaaagagtagaatacggagttcaatctgtgttgtgtgttttaagatgtgattcatctcatatgaatcaatgcttctctagctgctctctctgtttagtaatataatatgaacctctcactgtatacatttttttttaagttccggtatacacgtgcagatttgtcacataggtatatatgtgccatggtggtttgctgcacctatcaacccgtcatctaggttttaagccctacatgcattaggtgtttgtcctaatggtctccctttgcccccgactccccgtgtgttctcattgctcaactcccacttatgagtgagaacatgcggtatttggttttctgttcctgtattagtttgctgaggatgatggcatccagcttcatccatgtccctgcaaaggacatgacatcattcctttttatggctgcatagtattccatggtgtatatgtaccacattttctttatccagtctatcattgatgggcatttgggttggttccatgtctttgctattgtaagtactgcttcaataaacatacatgtgcatgtgtctttatagtagaatgatttatattcctttgggtatatacccagtaatgggattgctgagtccaatggtatttctggttctagatccttgaggaatcaccacactgtcttccacaatggttgaactaatttacattcccaccaatagtgcaaaaccataaaaacctcagaagaaaacctaggcaataccattcaggacataggcatgggcaaagccttcatgactaaaacaccaaaagcaattgcaacaaaagccaaaattgacaaatgggatctaattaaactaaagagcttctgcacagcaaaagaaactcgcatcagagtgagcaggcaacctacagaatgggagaaaaattttgcaatctacccatctgacaaaggtctaatatccagaatctacaaggaacttaaatttacaagaaaaaaacaaacaatcccatcaaaaagtgggcaaaggaaatgaacagacacttctcaaaagaagatatttatgtggccaagaaacatatgaaaaaaagctcatcatcactgatcattagagaaatgcaaatcaaaaccacaatgagatactacctcatgccagtcagagtgacgattattaaaaagtcaagaaacaatagatgctggcaaggctgtggagaaataagaacgcttttacactgtttacatttctacaaaactgtttttaatcatgaatgatattcttttttattaaaataccatctttttgggggtcaattttttttctaaatctgcttccccagagctatgactcttgatctaatgtctttgagacctttatatatattttatatgagtcttagaaacagtatttatagaatatatcacatatgcacactcatgtatttggtacagatgatgcacataacagcttacaacacataattgtgtggacatttctttttggtttttggctcaagaatatattatggccatcattcaatgtgaagacctgcaaagatagtaaacctcattcattttaatggtagtattgtatcctataggatacatcagaatttgtgtatttgcgccaggcgtggtggttcacacctgtaatcctagcactttgggaggccaaggcgggcggatcacaaggtcaggagttcgagaccagcctggccaacatggtgagacccccatctctaccaaaaatagaaaaattagctgggcacggtggtgtgcgcctgtaatcccagctactcgtgaggctgaagcaagagaatcgcttgaaccttgggggcagaggttgcagtgagccaagatcgtgccattgcactccagcctgggcgatagagcaagactccatctcaaaaaaaaaaaaaaagaatttgtgtatttgtatcattttacttagttttattattaatcattttatttagaatggatgcatcataatgtagttatcatggtgaggaacacgggttgcctttaaacttttcagtgttacacatagtgttagaatacacatccttattcggtatattttgtatacttagaggagtgtttctgtgggatagtttcttagaaccttttgattcttagataattaattcaagtattagctctgtggagctgtttctgatcgctcataggcagagttcattagtcatttgcctgtattctcataatactttgtagattctttttataatacttatgttttattttcatttttaatttacatgtttgttttcccacttgatagtcagctcttcacctgagaatagggagggaagaggatgcagcccagtgcccagctcatagcagtgcttacagattctcctgacatttaaattatttagtgttgtctggttgctcctgctttgttctacaggttaaactccatctatctgcataatcagattgatagaaatgttcaatctgaggttgaggattacatgatgattaaggatgaggtaattatgtagttgtgtatgtgtgtgtgtcttttaagaaaaaatgggaggtacacagaaactgtgtaagttggaaatttaccatttataattctttcctttctaggtgtttcaggcctcacctgaagatcatgaaaaatacggtggggatccacagaaccctcataaactgcatattgttaccagaataaaaagtacaagaagacgtccatattgggaaaaagatataataaagatgcttggattagaaaaagtatgcaattattttaatcatctttagtgttgtttacattgctttaaattttatacttttaaaactttgcggtatacatttattatttattttgtattacttagggtaatttatttataaatttggcttagaatgaaccttcaatttaacattttactgaaacatggaactatctgcttttcagattgataacgttgctttgttgttgttgttcacaggcacatacccctcaagttcacaagaatatcccttcagtgaatgcaaaattgaaagtagttaagcatttgataaggtttgttgtttcttctcagctctttttaaaatgtattgcctagtgtaattctaaatgcatttttcttttttcgttaatgttctgaaaaaaactttttaaaaaactaaaattttattttgtttttttttaattgacacataataattgtacatatttatggggtacatagtgacgtttcaatatatataaagtatagtgatccgatcagggtaattggcatatccatcatctcagacatttaccatttcttcatgttgggaacattcaacatcctcctcctagctatttgaaactatgtgttattgttaactgtagttatcctgcggggatatagaacgctagaacgtattcctcctatctaaacgcattttcttgtgtcacagaatcaagcccttgaagttgccacaaggacttccagcagaggagaacatgtctaacacgtgcctcaaaagcactggggagttagtagtgcagtggcatctgaaacctgtggagcagaaagcacatgagtcctaatgccccagcagcttccgattggaaaatgcaaattgtttttatttaaagatggtgagaaagtgttttcattaaaatatgttttcaaaaccattttcaggccgggcacggtggctcacctgtaatcccagcactttgggaggccaaggcgggcagatcacctgaggtcaagagttcgagaccagcctgaccaacatggagaaacccccatctctactgaaaatacagaattagccaggcatggtggcacatgcctgtaacccagctactcgggaggctgaagcaggagaatcacttgaacccgggaggcagaggttgcagtgagctgagatggtgccactgtactccagcctgggtgataggatgagactccatctcaggggaaaaaaaaaaatttttttttcactgactaaacctgctgcagctctcttttactacagacttggagattttagtttaatttggtttaattctctgtcctttccctttcactgtttcactccaaaacatgtaagaatggcaatgtttgaacatctgcgtttgggtctactgccaccttagcaagcctcattaaccattttataaaaattgcgttagtattgttgttgttgtttttgagacagggtcttgctctgtcacccaagctggaatacagtggcatgatttcagttcactgcagcctcgacctcccaggctcaagtgatcctcccacctcagcctccagagtagctaggactacaggcagtgtgccaccacatccagctaattttttaaagttttttcatagagacagggactcactatgttgtccaagctggtctcaaactcctgggttcaagccatcctcccacctcagcctcccaaaatgctgggattacaggcatgagccactgtacccagccaaaattgttttcttttttaagtgaattcaacaatttctgtgagtggctctttgcatgaacactgtgcaaggtgttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttattcaaaaacagactattctgttttcagcttcagaattgttctttgaatcctaaggaacctctgtcaacagttgaggttgctgttgaaaagaaagaagaaggaggcggaaatctctcagggagaattatttcctttcttttctattttagatacctggaggggtggggagaagtaagaattgtaagggaggttcagtagtggggaattctgtgacagctgattgaagatgatgatgaagaacctctgcattctagttaccctttgcttcccttcacctcttgtaaaatttggcttggcaacaatgacattgtcatgcttattgtcccaatatccatcctgtcgtagatcttaatgtttttgatcgttgcgttaaagtggaagtgccacccacagtgaaaccagatcccattaataaataagcttaaaggcaactgcagttttaattccatagttattgaatatccagtgtgtgtaaggcctggaggggagccaaaggacactaacttctaagagctccgtctagttggagagaaacctgtgtgccacaacatacagtgtccttgcttatgtggggtcgaagacatctgtgaaaataaaagcagcctctgctaatttagcgccatctcttttactgtgctaatttttttttctttagagacagggtctcactctgtcgcccagcctggagggcagtggtgtgatcgtagctcactattacctccaactcttgggctcaagtgatcctcccacctcagcctcctgagcagctaggactacagatacatgccaccgctcccggctagtattttttaaaattttttgtagagccaagtgttgctatgttgtccacactgatctggagcttctaatctcaaatgattctcctgcctcagcctcccaaagtgctgggaatacaggtgtgagccaccatacctggccttactgtactaatattaatattgtgtaaataggggaaaataccatggttaatttttactcaaacagtaagaaagtttgagtaactaattttaatctcaacagcccatagctagaagaggggatctaaatgttaagttgaatatttagaaataaaagtgtctacaagaagaaaagtctttagtgaaaatatgggcataggccagcagcattagctttctattgctgcagaacaaattaccacaaacttagctgcttaaaacaacacacacttattgtctcacaatgtttgtgggtcggaagtctaggcgtggcttagctgggtagtctgtttaggatctcagtgctggaaaaacgtgtctggccaggtgctcattgtagctttgacagggaagggatctgctcccaagcactctcaggttgttggcagaatttgtttccttatggctgtaggattcatggcaagttgcttcttccaaaaccagcattggagacagactagcaagatgggcactacactcttagataatcaaataaatgcaatcatgtgcctcgtgtcaccttttttgcattccattcattaagaacaagttgcagttcctacctacactcaaggaagggaggaattacacagaagtgtgaccacaggaggcagggctcatggaggcctccttaaagtcccccagccaaacctgaaaagtcaatcctggaccttatcatagtggctgtatagtttagaaggtttcttcagattggcattcctttgcctcatatcatcacttcaaaaccctataagggtttgttcctcggtcttgactttgtgtctttgaggattgctttgtttagtgtcacctgccttctttcaggaggttttgcctgacatctggtggtgaccgtggccaccaagtcaacccaaacactacctttaaggacgactgcagttctcttagggtctcctcaatctaaaattgtacctctttcaggccaaacacctattttcttcattttttttttctcataagaatgctagctagtatgcctattatctaactggcacagtttcaccaaggacagtttggaactacacaggccattttagggagattttgacatgaacaagattgcttctttgggaggtaccttaaaatgaaaagcaaagaaacttccatgcggagattgtcttgtttttctcaaaatgggataattttgcttaacataagtagtatcccttccttcctttccatactttgagaattaataaggactagctttttgatcacacagcttgataaaattttcaagggtccaaattactgtctaaaccatttgccactctttgtgtatatttgtcaaaatctgcttttctatatcaaaacttttctctcaagacctgagggaattaattaataaggaatccttggaacactggaaattctaaaataagagtcagatacaaaacactggtcactaaaattcttacctttatgtattagaatggcaatcaatgaacaaactgaaaatgtctttggatattatttctgtttattttttgcctcaaaattattaaatgacatgaaataagtgctcaagaagaaaaataaacaattcttcatttcctgttctctagttttccgtattacctggaaaaaagaaaatttgttggtcactttaaagataatataaacagctgaacatggtgcacaccccgactccccaccccactcccatgcctgtaatcctagcgctttgggatggcaagatggatcacttgagtctaggagtttgaggctgtgatgaactatgattgcaccactgcactccagcctaggcaacagggcgagatcctgtctcaaaaaagaaaaaagaaaaacagagcggtacaattactgtctcccaaaagattatttccattattctagattcaccagtcctccatacctcttttctttttattataaagctgaacaggcactagggtactgattgaactaagtggaaatcaccaggggtccattgcttatttcgtaagatccagtagccaagacatactcaccccatctgagaactatagcagtagcaataaaagtgaaaacttcagttgatttagttccagggtttccactaaacttgacagcttcccatgctgtgctgtacagggtcttctactgacagtaaactcgcaggatttttcagctacttacctagtctcccatgaattttgttgctttgcttttacacatcactggcctatattacaacactctaaactcagccacttccttcacccaaaaaagcaaccgcccataattgcttacccctcttagggaacgatccataccctgcacagacttagagattcccttggagaactgatttaattgtggttttagattattcacacttaaaaagtgaaactaaaaattgccaagtacagtcaggcgtggtggctcatgcctgtaatcccagcaacttgggaggctgaggtggggggatggcttgaggccaggagtttgagaccagcctgggcaacatagtgagaccccatgtctaaaacaacaaaacaaaaaattttaacttagctgggtgtggtagcacatgcctgtagtcccagctgctgaggagactgaggtgggaggattgcttcagcctgggatttcaaggctgcagtgagctatgattgtgccactgcactacagcctgggcgacagactcccctggggtggggcgggggggaatgctatgtagactatcatcatagtcaaagcttttctcagaaatcgtattcatttagtttggctaaattaattgccccctcccagatctgccaagttacaaaagtaaatatttatattgatacaataggaggtatttgatgtgggggtagtgtatgactttgcaatgctttagaaacaacaacaaaaatcacctgaccactacaggaacccctgtagaattgacaatgaattaaagagccttgacatgctttgctgttatggaaggagatggccataagaaaaatggaaattagcaaaactattttgtgatattacccacaatagcagagaagaattggcaaaagtattgaaccaagattgatagggtaatttaagcatattgctgaggatgttttgaatgtgtgtcccacctgccagtgacataatcctgacaagatcgttataacaggacctaggaatcttgaggcccattgaacaccttgattttctatcagctagccaaggaggacttgatactatcacaaacatttcttgctgtacttacacactacagggcaagcaaaacagaaaatattaagataaacaaaaaagccacctgactccctaaaagacccatctggattctgggacatgtttcttcacctgggttttataatctggtatcccagcattaagacccgttataagactcatcatccttttgtttctggtaatggcctgttacagttggttgatgtacactgtccaaaatctggaatgctgctctgtacccactgtcaagtcaaaggtctcaacagctcatcctgcaacaggagaagggattagctctagcccaactacagaccatgcttccgggacatcctcctggtcttgacagtggtgaaaatctggatgtcatgaattctgtggcctgacttcacctgcccttgactaaagagggggattgaggaaaagaaaaagcaacttctgacagccaggaactggcctggaactctcaggccttggtgtttccaggagctggcctggcctcacaggtggtgttcttctgttgaacataaggaatttcacagaacatcaacatcagataaagctgcactgaatgtaatggatcatggcaaaaacaagaccactctagagtcatgtctgagcacagaccaaaacatgaatgtgattcaagtcacaaaaataaccaagcatccacctattctggctaatgtgggtcactgcagctttgccaatcacagcttgagcttcatttcatttctccctccttctaggtaacattgattaagataccaatcacagaatcatctttctcctgacagcatccaatccagagcaaaacctactttttgaaacactcaccaaaataacctgataaaagcccagatcctttccaaacccctcttcctggactgctccacatggggacatggggtggttctcctcactgcagtgagcacaggccttcacttctcagtggacccgaccaggcctgtttgtcacatccctgctggagtgcctcatgcaggtctgtttgcccactctgtcccctgtctaggctcccagcaattatccctcatggtctcctcctgattaatgggccctgccccaccacactttttccaccccatccctggctttccttctgccagcacagccttctctactgttgccccagctgttctcagacattttctcactcccaccgtggtggtaagacttaccacctctgctccagagtctcaggccactgtgtcctcttcaccatccatccgacccctaccatgtgcttcctcatcttggccaccagggtcttcttggtcatcagaccctacttctttttttattattatttttaattattatggatacataatagctgtataaatgtatgggatacatgtgatgttttgatacaggcacatagtgtgtaataattgtatccaggtaattggtgtattcaccacctcgagcatttattatttctgttagaaacattccaattcaattttcagttatttttaattatacaagaaaaatttgggaggctgaggtggcaggatcacttgaggccaggtgttcaaaaccagcctgggcaacatagcaagaccccgtctttacaaaaaaaattttaaaaatgagctgggtgaggtggtgcacacctgtagtcctagctactcaggagactgaggcaggaagatcacctgagctcagaatttgaggctgcagtgagctatgattgtgccactgcactctggcatgagcaacagagtaagacactatctctaaaaaataaaaaatatgtatataataaattattgttgactatggtcaccctgttatgctaatactagatcttattcactctatatttttgcactcattaaccatctatactttttcccccatccccactacccttcccagtctctggtaaccattattctactatctctatgatctcaattgttttaatttttgcatatgagtgagaacaagcaaaatttgtctttttgtgcctgggttatttcacttaacctaatatcctacagttccatctatattgttgcaaaagttgggattccatttttatggctcaataatattccattgtacatatgtaccacattttctttatccattcatccactgatagacacttaagttgattccaaatcttggctattgtgcagtgtaaatgtaaatctgcactccatgcaataaacatggagtgcagatatctcttcaatatactggtctttcttttggatatatacttaacaatggcattactggatcatatggtagctctatttttagttttttgaggaacctccataatgttctgcatagtggctgtactaatttacattcccaccaacagtgtacaagggtttccctttctccacatctttggcagcattcgttattgtctgtcttttggataaaagccattttaactggagttagatattatctcattgtagttttaatttgcatttctctgatgattaatgatgttgaacattttctcacctacctgttagccattcgtatgtcttcttttttttttttttttttgagaaatgtctaatcagatattttgcccattttaaaattggattatttgattttttcctattgagttgtttaacctccttatatattctggttattaatctcttgtcagatgggtagtttgaaaatattttctcccattctgtcggttgtctcttcactttgtcgattatttcttttgctgtgcagaagctttttagcttgaagtgatccctgttacccatatttgcttttgttgcttgtgcttttgaggtattactcaaggagtctttgcccagatcaatgtcttggagcatttccttaatgtccttctcttctcttctcttctcctcttttctcttcctttttcctttatttatttatttctcttttcttctctttctttcaacaaggtctcactctgtctcccaggctggagtacagtggtgcattcatagctcactgcaaccttggactcctgggctcaagtgattccccaatctcagccacctgagtagctgggactataggtgttagccaccacacctggctatttttattttatttctgtagagacaaggtcttactatgttgccaaggctggtcttgaattcccaatgttctcttttagtagtttcatagtttcaggtgtcagatttaagtctttaagccactttgatttgatttttttatatggtgagagataggggtctagttcattattctgcatatagacatctagttttcccagcaccatttattgaaaagactgttctttccccaatgtatgttcttggcagctttgtcaaaaatgagttcattgcagatgtgtggattcatttctgaattctctactgttacattggtctatgtgtctgtttttataccagtaccatgctgtttcgggtctctagttctacaataaacttcaaagtcaggcaatgtatttttctggttttgttctttttgttcaggatggatttggctattctggatcttttgtggttccatataaattttaggataattttttctatttctgtgaagaatgttattggtattttgatagggattgcactgaatctgtagattgggtaatatgaacattttaacaacattgatgtttttcaatcaatgaacatggaatatctttcttttttttttttttttttttttttttttttttgagacaaagtttcactcttgtttcccaggctggagtgtaatggcacaattttggttcaccgcaacctccgcctcctgggttcaaatgattctcctgcctcagccttcggagtagctgggattacaggcatgcgccaccatgcctggctaatattttgtatttttactagagatggggtttcaccatgttagtcaggctggtctcgaactcctgacctcaggtgatctgttgcaggaagtcagagaccctgaacggagggatctgccgaagccatgacagaagaacataaattgtgaagatttcatggacatttatcacttccccaatcaatactcttgtaatttcctatgcctgtctttactttaatctcttaatcctatcatcttcataagctgaggatgtatatcgcctcaggaccctgtgatgattgcattaactgcacaaattgttcataaagcatgtgtgtttgaacaatgtgaaatctgggcaccttaagaacaggataacagtgattctcagggaacaagggagataaccttaaagtctggctgcctgtgggctgggctggacagagccatatttctcttattacccaaaatgggcaagagaaatatcgctgaattctttccccagtgaggaatattaataattaacagccctgggaaaagaatgcattcccagggagagcctctaaaatggctgctctgggggtgtctgtcttgtgcagttgcagataagggatgaaacactccctggcctcctgcagcacccccaggcttgctaggattaggaaattccaggctggcgaattctagtcagaccggttctctgccattgaacctgttaagatgtttacaatgacaatgcgtgcacagcgggacatggaacttcattagtaactctagttttgccctgaccttgtgatctcaccctcaccttctgccttgtgatcttttgtcacccttgaagcatgtgatctctgtgacccacaccctgttcgtacactccctcccctttgaaaattgctaataaaaatttgctggttttacggctcagggggcatcacggaacctgccaacatgtgatgtctgccccggacacccagctttaaaatttctctcttttgtactctttccctttatttctcagaccggccgactcttagggaaaatagaaaagaacctatgatgaaatattaggggtggttcccccaatagtggtccacccacctcagccttctaaagtgctgggattacaggcgtgagccaccacgcctggcctatctttccattttttgtgtgtcctcttccattctttcatatgtgttttataatttttattgtagaaatatttcacatggtgagccaccctggcatcccagggatgaatttcacttggttatgatgaatgaccactttcatgtgttgttgaattcagtttgcttgtattttattgagattttttgcatctatgttcatcagaggtattgccctgtagttttcttttttagtatgtctttgtctgtttttggtatcagagtaatactggccttatagaattcatttggaagtattccctcctccttgatttttttgtaatagtttgagtaggattcattttagttcttctttaaatgtttggtagatttcagcagtaaaggaatcagatccagggcttttctttgctggaaaacttttttttttttttttcagacggagtcttgctctgtcacccaggatggagtgtaatgccacggtttcagcttactgcaatctctctgcctcctggcttcaagcatttctcctgcctcagcctcccgagtagctgggaccacaggtgcgtgccaccatggctggctaatttttgtacttttagtagagacggggtttcaccatgttgaccaggctggtcttgaacttctgacctcaaatgatccacctgcttcggcctcccaaagtgctgggattacaggcgtgagccactgtgcccagcctggaaaactttttactatctctttgatcttgttacttgttattggtctattccggttttggattacttcatgtttcaatcttgtatgtatctaggaatttatccatttcttctaggttttccaattcattggcatatagttgctcatagtgctttctagtgatcctttgaatttctgtggtatcagttgtaacatctctttttaaaatctctgatttcatttattttagttttctcccttttttcttagcaggataaaagtttctcagtttgtttatcttttcaaaaaaaatcagtttttcatttcatttatttgttcatttattcttttttttttttttttttttgagacagagacttgctctgtctctgtcacccaggctggagtgcaatggcacaatctcagctcactctaacctctgccttcggggttcaagtgattctcatgcctctgcctcttaaataactgggattacaggtgcacatcaccatgcccagctaatttttgtgtttttagtagagattgtgtttcaccatattggccaggctggtcttgaactcctgagctgaagtggtcagccctcattggcctcccaaagtgctaggattacaggcataagccaccatgcccagcctgtgttttttttttttttttttagtttcacttttgtttatttatgctctgatctttatttttttttccactaattttggatttggtttgctcttgcttttctaattatttaagatgtattgttaatgtattagtttgttctcacactgctataaatatactacctaagactgagtaatttataagcaaaagaggtttaattgactcacagttccacatggctgtggaagcctcaagaaacttacaatcagggtggaaggtgaagggaaagcaaggcacatcttacatagaagtaggtgagagagagagagtgtgtgtgcaggggaagagccacacacttatcaaacaaccagttatcatgagaattctatcacaagaacagcaagcggtaagaccacctccatgattcagtcacctccaaccaggccactcctctaacatgtggggattacaattcaagacaagatttgggtgaggacacagagccaaaccatatcatttaggttgtttgatgtgaagttttcctaccttttttgatgtaggtgcttattgctataaactttcctcttagtgctgcttttcttgtatcctgtatgggtatgttgtgtttccattttcatttgtttcaagagacttttaaatttccttcttgatttcttcattgacctgccggtcattctggagcatattgtttaatttccatgtatttgtatagtttccagagttctttctattgatttctagttttattccattatgatctaagaagatacttgatattatttcaattaaaaaaattttaagactttgttttgtggcctaacatatgttctattctttagaatgatccatgtgctgagaagaatgtgtattctgtagccattggatgaaatgtaaatatctgttgtgtccatttggtgtatagtgcagattaatctgatgtttctttgttgagtttctgtttggatggtctgtccaatgctgaaagtgggtgttgaggtctctagctaatattgtattgaaatctatctctctctttagctctgataatatttgctttataaatctgggtgctccagtgttgggtacatatatatttacagttgttatatcctcttgctccctttatcactatataatgaccttttttgtctttttttataatttttgtcttgtcttgaaatatattttttctgatgtaagtgtagctattcttgctctttttttggtttccatttgcatgtaatatcttttttcaaccctttgttttcagtctgtgtgtatctttataggtaaagtgagtttcttgtagccagcatatagttgggtcttttttcttaattcctttagccactctatgtcttttaattagaaagttcagaccatttacattctatgttattgataggtaaggacttacaaactgttgccattttgttatttgtttctggttgttttgtcagcctctcttccctccttcctttggtctttctttgtgtaaaagtgattttccctgatagtatgttttaatttcttgatttttatttttcatgtatctctgtaggttttttgatttgaggttactgtgcagcttgcaaataacatcttataacctattattttattttattttattttattatttatttatttatttatttatttttttagatggagtcttgctctgttgtccaggctggagtgcagtggcacgatctcagctcactgcaagctccgcctcctgggttcacaccattctcctgcctcagcctcccaagtagctgggactacaggcgcccgccaccacgcccagctaataacctattattttaaactgataacaacttaattctgatcacaaaaaaacaacaaacaagcaaagagaaaataaaaactatcctttatccccattttaaaactttttgttgtttctatttatatatttttatactatctcttgaaagtcatcatagttattatttttgataggtttgtcttttagtcttcctattcaatatatgagtatgtaaccaatatatgtgtcttatacatcacaattacagtgttgggggtgttggggtattctatatgtgtctgtgtaccctctgttatcagtgaattttagatgattgcttattgctttttaaaattcttttctttccggttgaagaactccctttgacatttcctgtaggacaggtctgatattgacaagctcttccctcaccttttatttgtgtggaagagtcttaatctctccttcatatttgaagggtatttttgctggatacaatattctgaaataaaagttttattctttcagcactttgcatatgtcataccactctctcctgacctttaaggtttccactaagaagtcagctgccggttgtattagaactcctttatatgttgtttgtttcttttctcttgctacttttaggaccctttctttatccttggactttgggaatttgatgattaaatgccttaaggtcttatttgagttaaatctgcttggtgttctataaccttcttgtacttggatattttctctaggtttgaaaaattccatttctatttctttgaataaactttctaccttcacctcgctctctacctcctattttaaggccaataatgcttagatttgcctattgaggctattttctagatcttgtagggttacttcattcttttttattctctttttattttttctcttctgactgtattttcatatagcttgtcttcaagctcactaattctttcttctgcttaatcaagtctgctattgagagactgatgcatttttcagtttgtcaattgaatttttcatctctaaaatttctgcttgatccttttaaattattctaatctccttgttaaatttctctgatagggttttgaatttcttctctgtgttctcctgaagttcactgagcttcctccaagcagctattttgaattctgtgtctgaaaggtcacatatctttgtcactctgggattggttactgattctttgtttagttcatttgctgaactaatattttcctggatgctcttgatgcttgtgaatgttcattaatatctaggcattgatgattgtgttagtctgttctcacactgctgtaaataaatacctgagacttggtaatttattaagaaaaggggtttaattggctcacagttctgcaagctgtacagggagcatgtctgggaaggcctcaggaaacttacaataatggtggaagggcaaaggagaagcaagcatgtcttcacggtggcagaaagagagagagagagagagtgaaggaggatgtgccacacacttttaaaccatcagatctcatgagaactcactcactatcatgagagcagcaagggggaaatccactcccatgatccaatcacctcccaccaggtccctcccctaacagtgggaatcacaatccaacatgagatttgggtggggacacagagccaaaccatatcaatgagttaggtgtttattctaatctttgcagtctgggcttgtttgtacctgtccttgttaagaaggcttttcagattcaaagggaattgagtgctgtgatctaagtctttggtcactgcagtcttatctgtactagaaggtatcccaagccctctatctgtacatggaatgggtggatggatggatagtatgagtctcttgaagactcatagaggtaccgccttcatggacttgggtgagatctggaagaattccctggattaccaggcagaatctctcattatcttccctcattttccctaaaaggagtctctttctctgtgctgggctgtctagagttggagaatgggtgatgtaagcactactatggccaccataggtaggactgcactgggtcacacccaaattcagcacagtactgggtctcatccaaggcccttggcaactactgcctggctactgctgatgcttattcaagacccaaaggctctttcctcagcaggtggtgaattttgccaagactaggtccttctctttagggcagcatgttttcttctagcctagggtgagtctagaaatgccatccagaagctagggcctaaattcaggggcttcaggaatctgctaagtgccttattttactgtggctgtgctagtacccaagttgcaggacaaagtcctctttacccttccctctcttttttgcaagtggatggactctctcccagagctgcactgcctggaatttggggaggggtgatgcaagcactcccttggccagtacaactggtgtctcactgggtcacatgtaccccaagttcacaggctctgagcccattgcagtaccaggacttgcccagggactgcagtccttgtggctaagactgcctttcaaatatatttaggaccccagtccacttaagtcagcaggcagcaaagctggccagaactcagtttcctattgctagggcagacaattcctctctggccaaaactgatctaaatgctccctccatgggcattagccgaattcatctctgtgttgcttttggctgtgacagggcagcagggagttccagtgcagaatcccatgatcacttcattctccctcccctgagcacacaaattctcttttggcacatgacactgccaggggatggggaagggatggttaggccagtggtcccccgcctttttggcaccaggaaccagtttcatggaacacaatttttccacggaccaatatggaggggatggggatggtttcatggtgattcaagtgtattatatttattgcgtagtttatttatgttattattacattgtaatatataatgaaataattatacaattcaccataatgtagaatcagagggagccctgggcttgtcctcctgcaactagacagtcctatctgagggtgatgggagacagtgatagataatcaggcattagattctcataaggagcatacaatgtagataccttgcatgcacggctcacaatagggttcacattcctatgaaaaccaaatgccgctgctgatctgacaggatgcacagatcacgtggtaatgctcactagtccaccgctatgtggcccagttcctaacaggtcatggcccagtactatcttttttttttttttttttttttttttttttttgtggagttgtggggggtaattattttattttactttttaaatttaaattgtttaatattaaatgaacatggccacattataaacattgaaaactaaaggaaacaaaggtactaaatgctaacataactatttctactttaatatatctctttttacataatgtatattcaaatatatactgtatatgcagtgttataactcaacaatgtattataagcatttatgtgttatcacaaagccctcataaccactgtttcaatagctgcatcatattctgttggttaaatatagcaaaacttatttaaatagtctcctatggaatatataggtatgtggtctaagggttggggacccctggtttgggcaatgcaagactgtctttcctgccctcttcagtacctttttccttgatatgatattaaacccagtactgtgattgctcacctgattttgagttcttatgaagggactttcttgaatagatagttgttgaatttggtgttcctccagagggatgatcactggagtgttttatgcagccatcttgccctgcctcctcccagcttcaaaaaatccctacctcttctcaacttctcccttggtcaccatcaattctaggcttctttctgttacctgagccctatttgcccctagatcctacagtcttaatggaccacctcccaacccccacccccaccagagcacactcagataatgaatctggtttctcaactagacccccacctcgtctctagactgatcctcctcaccagatcccaccctcacccaggaaatcaacctttcacccaacttgattcccccgtgaattctactgaatcatttgcctggcaacccacccccaccaatcctcttgctatggtttggctgtgtcctcacccaaatctcatcttgaattcccacatgttgtgcgaggggcccagtgggaggtaattgaatcaccagggcaggtctttcccatgctgttctcatgatagtgaataagtctcatgagatctgatggtattataagggggagttccctgcacaagtgctctgtttgcctgccaccatccacataaaatgtgacttgatcctccttgccttctaccatgattgtgaggcctccccagccatgtggaactgtaagttcattaaacctctttcttttgtaaattgcccagtctcaggtatgtctttatcagcagcgtgaaaacggactaatatacctgtctactgcatgactatcagacacctgcataactctgactcaatctgacttaattcctgtccaactctatattgtcctagagaactcatgtccacataacacctgttggttggcctcttctgtccccacaatctcaggcttcaaccactcaattctgcccagttcattcttcttctggtaacaggcatctgcccaggacttgttcctccccacctgatcacactgatttctagcaagagcttcttttcttccatccataagaggcttctctctgaggaaatcctgaaatagttgtgtggagaccagtagcttctttctccccagccatgaaagccaggagctcctggagacacaagtcacaaagacagagtagttcacaacgtccactaatagtaatagcaactgactatcagaatatgtcaaagctcaatggacttttttgactcacccattacaaatgatgtgatcatttacataagtagttttttctgagagagggtctcactctgtcacccaggctggagtgcagtggtatggtcacagctcgctgcagccttgacctccccaggctcaggtaatcctcctgcctcagccttccaagtagctgggactacaagtgcatgccaccacacctggctaattttttaaatattttgtagagacggggtgtattagtacattttcatgctgctgataaagacatactgagactgggtaacttataaagaaaaagaggtttaatggactcacagttccatgtgattggggaggcctcacaatcatggtagaaggtgaaaggcacgtcttacatggcagcaagcaagagagaaagatgagagccaagtgaaaagggaaaccccttataaaaccatcagatcttgtgacacttattcactaccaatagaacagtatggaagaatccacccccatcattcaattatctcccaccagctccctccaacaacatgtgggaattatgggagctacaattcaagatgagatttgggtggggacacagccaaaccatatcgtggggtttcaccatgttgcccaggctggtctcctgatctcaagctatctgcccatcttggccttccaaagtgctgggattacaggcatgagccacttgcagccagcccacgaaaacattttttaagttagaagagaaattcttgcaccccgataaaagcgggagcatttgaggaaatgtggttgggacttctggggctctccatcctcatagctggggactgaatcccaggcttggatagaagactccttcccaaagagatgactctggcagcagcaatgttttctcctcccctctgctgtccagctcagcctggggcctgaggttgagcttgtgagactagcctttacccactggcaaggagaaatacagccctgttgggtaggggtcccccagctccatccagctcagcccactctccacaggcttcaaagcaggtaaacttctatcctggagcaggtgaaatggaaagaaaacaggagcaagagattattattatatattacattgcaggacaccttttctgaacttaggatttcaggctgtctgctcaccacctgttctggctaatgtgctgtttaaataaatggatgaatggatggatgaacagatagatggatgggtggatgcagagatggatgggtggatggatagatggatggatggatagatgagtgggtgggtaggtagataaatgggtgggtggatgggtggatggatggatggatggatggatggatggatggatggatggatggtgtgatatactttttaagtgctgtccggagccagctttgaggccaggactaggggccagtaagttcttttcttgagcaggtgattaagtccacactcccaacaaccgcccttgttggggtctcatacttggggccattatccacctgtgctaatcagtccatggccaggtaccacacaaccagggatagtcctatacccagagcccactgaacttattcaaatgagccaatcttaagcctgcttaccctgcttctcccactcctttctgcagaaaccacaacaaaggtgcttgcccatggctcctcgcttccctctgcctcatgactgatgccaattattccccttgtggccccctgtggtgtgacatgtactccctctccggggatccgtgagtatagaaaattatcttttcattggcagtcatctcctaatctgttggccttaccctacctaaataataataaaagctactcaaacaaatggatagcttgatggatggatggatagatagatagatagatagatagatagatagatagatagataacagatggatggatggatagatagatacatagatagatagatagatagatagatagatagatagatagatagatagatagaaacatgagagaataaacacttaagtaaggaaacaagcagctatagtgactgctcctgtaacacagtatggccctaacagcagccacagggcacacccctcttcccaatgcacctatatccttatcaccccagcacttcaccctcatgctggggctctggcccagactcactgggatgtgggaacaaaatggtaggttcttacaaaaggaactttttcctcctgaaatgaatgcctccctaggctcagtcagagcaggacttgcaggaagggaggtaaagagcagctggggcttctcacctgactcagggccctgcaggaagagaggagcacaacacacctctcagcttttgttttgtccacttcggaaatttctagctggtgtgtttaacctaatcaatcagaatcttggtgccttgataaatatgtttctcacggttcaatgttcccatgggtttgtggcatcatattcaacctcagaaatatagatctgggcatggtggctcacacctgtactcccagcactttgggaggccaaggcaggcagatcacttgaggtcaggagttcaagatcagactgggcaacatggtgaaaccctgtctctactaaaaatacaaaaattagctgaatgtgatgacaggtgcctgtagtcccagctatttgggaggcagaggcatgagaattgcttgaacctgggaggcagaggttgcagtgagccgagatagtgccactgtactccagcctaggtgacagagcaagactctgtctaaaaaaaaaagaaattcagacaagagggtcaataatttctcagggagaattcaacccttctaaaagagtagaccctaaattccaggttcctgttgggatgttaaagtatttattttacactgtacctcattaagttctccctctttagtctgcagtcatgctcactgaactttttttttttgaaagttaaattctgtttgtcttgctcagtcagtctcctgctttgaagagttcttacttttggttacagttgtccccaaactgtcagtttgtcacttatactcacatctcatttattgctttctcacaccctctggttcagaaatttggggggccactggcagggggtgttgcttttattaagtcattttctatatttacaatgttaatttggtaaaatctgtctgaatgtagagccttgacttagcacaattgcaagaaactgccttctcaagatgagagtatagaatagaacttggaaagggcccttgcccaaaacatctccctatcactctgccaaggggtgacattccacaatcagaagtatagttatttaaataagttttttgagatctattgtacagcatggtggcaatagctaataataatgtaatatatatttcaaaattgctaagagagcagattttaaatgttcatagtatgaaagagtgataagtatataaggtgatggatatgttaattagcctgatttaatcattccataatatacatatgtcatcattccataatatacaatatacatatgtcacattgtaccacataagtagatacatttactatttgtcaattaaaaataaaataagttaaggctttgagtctttaaaatcccctaggaaggggcaactcttcagaaaagagcgaggtctgagccactaactatccgagatgctcaggccaacatttcagtctgatggggttggggaaggaagtgggagtgtggggtccttgcaaagcagcagcctagaggagcacagaggagatccaccagggaggaagccccatttgggtgtatgagggctagaggtgcagggcagatgggacctagaagggcacattctgctgacttaaggcagagtatgagttaggatcattttcgtgctataagataagcagtccctgaatctcttctcatggtttatagccagaattcactggctaactgagccagccttcaccactctgctgtcacagcccgaatccatttcctgtacctccccaatcatttcagagaattgcagtcagccacaagataatagctgcacacagcaatggcatttatacctacaataaactataagataagacttcctttacaagtccatactaggcttgttcctgacttgattttagggagaaactattgagtagttcaacataagtaagacgttagctgacatttttgttggtgtcctttatcagatagagaggtttttttctctttctggattgctaagaagttttctttttttttttttttttaaatcatggatgcatattagatatcgccaaatgctttttctgtattctgaattttaagtcaaccttaaattactggagtaaactccactcggtattgaataattatctttcttatatattgctagatttagcttgctaagattttgttaagaattctgatggatattggtctttgactttcttttctgtttttcttttcttgcaatttagccgcatcccactaatttgggtatattatgttttcattattatacaatttgtataataattgtataataaataatttcatttttatacaatttgaaatatttttggccaggcatggtggctcacgtctgtaatcccagcacaggaaacggaggtgggcgcatcacatgaggtcaggagttcaagaccagcctggccaacatggtgaagcctcatctctactaaaaaaacaaattacaaaaattagccaggcatgatggcgggtgcctgtaatcccagctactcgagaggctgaggtgggagaatcgcttgaacctggtaggcggaggttgcagttagccaagatcgcatccctgcactcctttctgggccacagagcaagactccatctccaaaaaaaaaaaaaaaaaaaaaaaagaagaagaagaagaaatattttctactttgctttgtgattccttctctgactcatgggttgtttcaaagtatgttgttttgttttcagatatttagggattttatagatattttaacatttttactctcttttttttttttttttcgggcagtgtctcactctgttgcccaggctggagtgcagtggcataatcctagctcgctgcaacctgaaattcctgggctcaagcaatcctcctgctttagcctcccaagaatctaaaactacaggcctaccaccaggccggctactgaaaaaaaattttttgtagagatggggtctcattatgttgctcaagctggtcttaaattcccagcctcaagcaatcctcccgcctcagcctcccaaagtgctgagattacagacatgagccaatgagcctggccatttgctcttaaatttaatactcttgtggttacagaacatctctggtaagattttaatctttgaaatttattgagacttgtttgatggcacagatttggtctatctgagggaactttccatgtattcatgcacagaatgcctatttttttgttatttacttgaatggctataaatgtcaattaggtcaacatgcttgacagtatcttacaggtcttctagatcagcactgtccaaaagaaatgtaatgtcagccacatatgtaattttaaattttctagtagccacaatcagtgacgaaaaaagaaacaggtgaaattaattgtaataatacgttttatttaagcccaaatatccaaatagcattttaacatgtaatcaacataaaattacttattttattttatttttttggaaacagaatctcgttctgtcacccaggctggagtgcagtggtgcgatcttggctcactgcaacctccgcctcctgggttcaagcaattctcgtgcctcagcctcccgagtagctggaattaaaggtgcgcaccaccatgcccagctaattttttgtatttttagtagagacagggtttcaccatgttgcccaggctggtctcgaactcctgagctcaggcagtccaccctccttggcctcccaaagtgctaggattacaggtgtgagccaccatgcccagcctgtaatcaacataaaattatgaataaaatattttacattattgttttcattttaactctttgaaaatcagtgtgaacttttcatctcccagcaaacctcactttagactaatcatgtttcaagagcacaatagccgcttgtggctctagtggctatcatatcaacagcagagttctagatcctcaccaatttttttccttttattttattccatcaagtgcttaaagagggatgttaaaatcttcaactatgattgtggatttgcctatttatccctttatttttgtcagttttgcctcatttatttggtacatatgcgatcaagtaggcttcatccctggaatgcaacgtcagttcaacagacacaaatcaataaatgggattcatcatgtaacagaactaaagacaaaaaccacatgattatctcaatagatgcagaaaatgctttcaataaaattacacatccattcatgataaaacaaaactctcaataaactaggtattggggaacatacctcaaaataataagagccatcaatggcaaacccacagccaacatcatactgactgggcaaaagccagaagcattccccttgaaaactgacacaagacaaggataccctctctcactactcctattcaacatggtattggaagttctggccagggtaattaggcaagagaaagaaataaagagcatctaaataaaaagagaggaagtcaaactatccctgtttgtagatgacatgatcctattttacaaagccccgtaatctcagcccaaaagcttcttaagccgattaacaacttcaccaaagtctcaggatacaaaatcaatgtgcaaaaatcactgcttgatcgtggtgaataggctttttgatgtgctgctggatttggtttgccagaattttgctgaggatttttgcatcaatgttcttcaaggatattggcctgaagttttcttattttgttgtatctctgccaggttttgtatcaaaatgatgttagcctcatagaattagttagggaggagtccctcctcctcagttacattcacatatggcacaggagaaccaagatatgctctagtggatcttctgagccccaggcatagttatccatgcctccattagtaaaaagaactcttgtcttcttgaatcttctctaaagggttactagaataagacctcgtctttgcctgctattccaacagcacaagagcccccaaataatcagatggcagccatagtttaggttcagtgagttactgggtcccttggtagatatgttctctactatcatcctccatgcctctgcccctagaagccagatccttcagaccaacccaacttagtgttacagagactggaaacaaaaatatctctagtggctcactgggagtgatgctgagagatgtcccaactatttccaatacttcatttctagaaccatatatactctacctattgaggacctaccataaaatggccgttggttccaagttgtggaaacaaacaacgaccccttgttcgagaagcaggaaaaaggtgcctttaaaagtatgaaaggtgtggtggctcatacctgtaatcccagcactttgggaggccaaggcgggtgggtcacttgaggtcaggagttcaagaccagcctggccaacatggtgaaaccccatctctactaaaaatacaacaattacctgggcatggtggcaagtgtctgtaattccagctactcgggaggctaaggcaggagaattgctggaacccaggaggcagaggttgcagtgagccgagatcacatcactgtactccagcctgaacgacacagctagactctatctcaaaataaataaatgaataaataaatagataaatttttaaaaatataataaataaataaatcttattggaatttgttggcttgaggtccctggaagcattttgggtctctggccagaaaccaaccaattcagcaattgtggtatgtctggtgccccagtgtcaggagaacagagagagtaaaagaacaatggggtttggttccattctcttagagctgcagctgcacaaaattaaaagggaattcccctactccagtggtttggcttttgctgctgccatcacccctgccaaagggttttttatggaccagagcatgagagaatggagaaaaagtagaacaaaaatatgtgggatttttatctgtggcatttttctatttggccccttaattcagaactagaaagttttcctcaatgtttttctgtctctactcagttctcacttctgggtttgagatgcttagagttcatgcaggggaatactagagggaaaaataagggtaaattcatcgccagtttggtggtattctcatatcaaattctgatgtttttccctgataatcctgctgatatttatttgttggagtttttaaacagctgcccatgcatttgtccagattttatagttgtatttagtgtaagagaaaagtagtcatgtgtttgctccatgttatccagaactagaacccttcccttaatatcataacttcaaaatatagaaagcaaagcttaccagaactaaaagggagaatggaaacttttaaaattatagttggaaaccttaataccctcctctcaacaagtgttagacaaacatttagtaaaaataaaagatggagatgatataattagttgaccatcctatttttacttacacagggcactacatccagcaaccacagaatgcacattcatttcaagtgcacacacaagataaaaagcaaattccaggctgagaaaagatagttacgaagtatgtatcagataaggaattcatatccagaatatataaagtaatcctaaaaagcaattgggaggctgaggtgggcggatcacctgaggtcaggagttcgagaccagccagaccaacatggagaaaccccacctctactaaaaatacaaaaatagccaagcatagtcacacatgcctctaatcccagctactcgggaggctgaggcaggagaatcgcttgaacctgggaggcggaggttgcggtgagctgagatcgcgccattgcactccagcctgggcaacaaaagcaaaaactccatctcaaaaaaaaaaaaaaaaagaaaaagaaaaagaaaccactaaaaattggtaagagattttaaaggcacaaagcaaaagaagatatccaaatggccaataactaaaactaagactaataactaaataaataaaactaataactaaaactaagactgacaatagcaactgttggagaagtatgaagtaactggaactcttcatactttgttagtaagagtgtaaactggtaagaccacatgggaaaactttttggtagtttatttgttaaaaatttttattcatttatttttaattaggtttttttttttttttgagacagagttgcactcttgttgcccaggctggagtacaatggcatgatctcggctcactgcaacctccacctcccaggttcaagcgattctcctgcctcagcctcccaagtcactgggattacaggcatgtgctaccacgctcggctaatttttgtattattagtagagacggggtttcaccatgttggccaggctggtctcgaactcctgacctcgtgatccgcctgcctcagcctcccaaattgctgagattacaggcatgagccaccaccacgctggccttttaaaaatttttttgagatggaccttgtcctgtcgcccaggctggagtgcagcggcatgatctcagctcactgcaacctccacctcccaggttcaagcaattctcctgcctcagcctcccgagtagctgggattacaggcgtgcaccaccatgtatgggtaatttttgtatttgtatttttagtagagacgggatttcaccatgttggccaggctggtctcgaactcctgacctcaggtgatctccccaccttggccttcaactaaagtgctgggaatacaggcatgagccactgttcccggcctggtagtttcttatgaaattaaacagacatctaccctatgacccaacaactctattcatgagaatttactcaagagaaataaaagcatgtatctacaaaaagacttgtaacaaaaacgttcatagtggctttatttttaaaaaccaaaaaatgtctgtcaacctaagggataaacaaattgtagtgtgttcatacgatggaatactactcaatcataaaatgaaccaaccactgatccatgcaacagcatgcatctcacaggcattatgttaaacaaaaaaagccaggccaaaacagtataaactgtatgactgtatttatataacaggcaaaactaatctatggtaatacatgttggaatattggttacctttgagtggagggccacattgcctgggaagcggcatgaggcaaccttctgtagttatggaaatgttttttatttcgttacagatattgtattttttagttctggaattgccacttgattgccatctctatttctatgttgagattttactaccttttcattcattagaagtttaatttcctttatttcttgagcatactaacatacttataatatttaaagtccttgcctgccatttctaacatctgggtcatcttggggttggtccctccttgttgatttctctcttgatcatgggtcacattttcctgcttcttatatgtcatatgtaagtaatttgggattgtagcttggacattgtgaaggttatattataaatactttggattatgttaaatttatctgaaagttattgatttgtttgttgtagcaaaaattgatctgggaaggaaggaaggaaggaaggaagggagagaaagagagagtgagaaagaaagaaagaaagagccaaactgaacttctagaatttaaaaattcactgcaggaatatcaaaatacagttggaagccttaagaacagactaaaccaagctgaggaaagaattttagaggtcaaagactggtcctttgaattaatccagtcatataaaaataaagaaaaaagaattttttaaaaatgaaccagacctccaagagataagggattaaaaaagaccaaacctacacttcattggcattcccgagagacagtaagcagcttagaaaatgtatttgaggatatagcctgtgaaaatttccccagtcttgctagagaggtcaacatgcaaattcaagaaatttggagaactcctgtgagatactacacaagatgaccattcccaagacacaaaatcattagactttccaagttcaatgtgaaagaaaaatcttaaagacagctagagataagggtgagatctcttacaaagggaaccccattgggttatcagcagacttttcagcagaaatcttacaagccagaagagatctggggcctgttttcagtatccctaaagaaaataaattccaataaagaatttagatatacaatcatgtcatctgcaaacagggacaatttgacttcctcttttcctaattgaataccctttatttccttctcctgcctgatggccctggccagaacttccaacactatgttgaataggagtggtgagagagggcatccctgtcttgtgcccgttttcaaagggaatacttccagtttttgcccattcagtatgatattggctgtgggattgtcatagatagctcttattattttgagatatgtcccatgaatacctaatttattgagagtttttagtatgaagggttcttgaattttgtcagaggccttttctgcatctattgagataatcatgtggtttttgtctttggttctgtttatatgctggattacatttattgatttgcgtatgttgaaccagccttgcatcccagggatgaagcccacttgatcatggtggataagcttttcgatgtgctgctggattcggtttgccagtattttattgaggatttttgcatcgatgttcatcaaggatattggtctaaaattctctttttttgttgtgtctctgccaggctttggtatcaggatgatgctggcctcataaaatgagttaggcaggattccctctttttctattgattggaatagtttcagaaggaatggtaccagctcctctttgtacctctggtagaattcggctgtgaatctatctggtcctgcactttttttggttggtaagctattgattattgcctcaatttcagagcctgttattggtctattcagagattcaacttcttcctggtttagtcttgggaggatgtatgtgtcgaggaatttatccatttcttctagattttctagtttatttgtgtagaggtgtttatagtattctctgatggtagtttgtatttctgtgggatcagtggtgatatcccctttatcattttgtattgcgtctatttgattcttctctcttttcttcgttattagtcttgctagtggtctatcaatttcgtttatcttttcaaaaaaccagctcctggattcattaattttttgaagggttttttgtgtctctatttccttcagttctgctctgatcttagttatttcttgccttctgctagcttttgaatgtgtttgctcttgcttttctagttcttttaattgtgatgttagggtgtcaattttagatctttcctgctttctgttgtgggcatttagtgctataaatttccctctatacactgctttgaatgtgtcccagagattctggtatgttgtgtctttgttctcgttggtttcaaagaacatctttatttctgccttcatttcattatttaccctgtagtcactcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggagtaggtgtggtgctgaaaagaatgtatattctgttgatttggggtggagagttctgtagatgtctattaggtacgcttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatcccttcaccaaaccccatcgtctcagcccaaaatctcctcaagctgataagcagcttcagcaaagtctcaggatacaaaatcagtgtacaaaaatcacaagcattcttatacaccaataacagacaaacagagagtcaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagtgcctgcattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccacatatctacaaccatctgatctttgacaaacctgacaaaacaagaaatggggaaacaattccctatttaataaatggtgctgggaaaactggctagccgtatgtagaaagctgaaactggatcccttccttacatcttacacaaaaattaattcaagatggattaaagacttaaatgtttgacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaatctacggaatgggagaaaatttttgcaatctacccatctgataaagggctaatatccaggatctacaatgaactcaaacaaatttgcaagaaaaaaaaaaaaaccccatcaaaaagtgggtgaaggatatgaacagacacttctccaaagaagacatttatgcagccaaaagacacacaaaaaaatgctcatcatcactggccatcagagaaatgcaaatcaaaaccacaatgagataccatctcacaccagtaagaatggcgatcattaaaaagtcaggcaacaacaggtgctggagaggatgtggagaaataggaacacttttacactgttggtgggactgtaaactagttcaaccattgtggaagtcagtgtggcgattcctcagggatctagaactagaaatgccatttgacccagccatcccattacggggtatatacccaaaggattataaatcatgctgctataaagacacatgcacacatatgtttatagcggcactattcacaatagcaaagacttggaaccaacctaaatgtccagcaacgatagactggattaagaaaatggcacatatacaccatggaatactatgcagccataaaaaatgatgagttcatgtcctttgtagggacatggatgaagctggaaaccatcattctcagcaaactatcgcaaggacaaaaaaccaaacactgcatgttctcgctcataggtgggaattgaacaatgagaacacctggacacaggaaggggaacatcacacaccggggactgttgtggggtggggggagtggggggggagggatagcattaggagatatacctaatgctaaatgacgagttaatgggtgcagcacaccaacatggcacatgtatacatatgtaactaacctgcacattgtgcacatgtaccctaaaacttaaagtatagtaataataaaataaaaaaatgaaaataaaaataaaatttaaaaaaagaagtaaaaacctcacagcagcttatgttaatttttcaaacaaaaaatcatttattcacaagttacacaaaatattttttttactgtttacctgacatctaaagtaaaagcagaataaaataaacttctcaccaatagttaaaaaaaaaaagaatattctgccgaactaaacttcatatatgaaggagaaatgaaatctttttcagataagcaaatgctaaagaaatttgttacttctagaccagccttacacgaggtccttaagggagttctaaacatggaaacaaaggaatgatacctgccagcacaaaaacacagttaagcccagaaacatacgtagcctagagatcctctaaagcaactacataattgaggctacaaagcaatcagctaagagcatcatgacaagatcaaacctcacatatcaatattaaccttttgttaattgtctaaaatgccccacttaaaaggcacagagtggcaagttggataagtaaacaaaacccaacagtctactgtcttcaagagactcatctcacatgtaacaacacccataggctcaaaataaaggaatggaaaaaggtctatcacacaaatggaaaactaaaaagagcaggagtctttatatattctgttatatcagatagaacagactttaaaccaacaacagtaagaaaggacaaagaaggaaattacataatgataaaggattcaattccacaagaagacctaactattctaaatatatttgcactcaacattggagcacctagattcattaaaaagtacttctagacctacaaaaagacttagagagccagacaataatagtagggtacttcaacacccccgctgatagcattaaacaaatcaccaaggcagaaaactagcaaagaaattctggacttaaaactacacttgaccaattggacctaacatcaatctagagaatactctgtccaaaatcacagaatacacatttttcttgtttgcacgcagaacatactcttaagaccaaccacatcagccataaagcaagcctcataaaattaaaaaagaatcaaaatctgtccaggtgcggtggcttacacctgtaatcccagcactttgggaggctgaggtgggtggatcacatgaggccaggagtttgagaacagtctggccaacatggcaaaaccccatctctactaaaaatacaaatattagccaggtgtggtggcacatgcctggagcccccgctacttgggaggctgaggcacaagaatcacttgaacccaggaggtggaggttgcagtgagccaagattgcaccactgcactccatccggggttatagagtcttcaaaaaaaaaaaagaatcaaaatcatatgaagcatactctcagaccacagtggaataaaaatgaaatcaataccaagaagatctcaaaagcacaccattacatggaaattaaataactgctcctgaatgacttttgggcagataatgaaattaaggcagaaataaaacaaattctttgaaattaatgaaaacagagatacaacataccaaaatctctaggatgcagcaaaagcagtttaagaggaaaaattgtagtgctaagtgcctacattaagaagttagaaagatctcaaattaataatctaacatcacacctagaggaactagagatacaagaacaaacaaaccccaaagctagcagaagaaatcactaaagccagagcagaatggaatgaaattgagaccaaaaatccataaaaaagatcaacaaaagcttgaaagcttgaaaccttgaaaggaaacgttggttccttgaaaggataaacatgactgatgaacttcaaaagtaaccttggttccttcaaaggataaacatgattgatgaaccactagctagattaacaaagagaaaaaaaagatccaaataagcacaattagaaatgacaaaggtgacattacaactgatcccacagaaatacaaaagatactcagagaccattatgaacaaatctatgcacatcaattagaacatctagaggaaatagataaattcctggaaacacacaacctcccaagattgaattggaaataaaatgaaaccctgaacagaccgataatgagttctgaaattgaattagtaataaaagaaaaaaaaacataacaaccaaaaaattccctggcccagatggattcacaatcaaattctaccagacatacaaatcctcaacaaactaggcattgaaggaacatacctcaaaatactaagagccatcactgatgaactcacagccaacatcatactgaataggcaaaagtgggaagcattccccttgagaactggatcaagacaagtgtgcccactctcaccactcctactcaacatagtaccagaagtcctagccagagcaatcaggcaagataaataaataaaaggcactcaaataggaaaagaagaggccaaactatctctcttcatggatgatataattctgtatctaggaaaccctaaactggaagacagctagaactcataaacaacttcattaaagtttcaagatacaaaatcaatgtacaaaagtcagtagcatttctatacaccaataacgttcaaactgagagccaaatcaggaatacaatcccaactataatagccacaaaaatattttaaaatctaggaatacacttagtaaaggaggtgaaagatctctacaaggagaaacacaaaacactgctgaaagaaatcatagatgatacaaacaaatggaaaaacatccatgcttttggattggaagaatcaatattgttaaagcagtctacagatttaacactattcctatcaaactaccaacatcatttttcacataattagggaaaaaaaaactattgtaacccaaatggaggctgaatagccaaagtaatcctaagccaaaagaacaaagccagaggcatcactttacctgatttcaaactatattacaaggctacagtaatcaaaacaacatggtactggtattaaaacagatacatagaccaatagaacagaacagagaacctagaaataaagccacacatctgcaatcatctgatctttgacaggtgacaaaaataagcaatggggaaaggactccctattcaataattggtgctgggataaatggctagcctatgcagaagaatgaaactggacccctacatttcaccatatacaaaaatgaactcaagatgaactaagaacttaaatgtaagacctcaaactatagaactcctataagaaaacctgggaaatacccttcttgatgatggctttgggaaagaatttatggttaagtcctcaaaagcaattacaacaaaaacaaaactcggcaaatgggacctaattaaactaaagagcttctgcacagcgaaagaaactattaacagagtaaacagacaacagaatgggagaaagtattcacaaactgtgcatctggcaaaggtctaatatccaggatctataaggaagttaagcaaaccaacaaataaaacacaaataaccccattaaaaagtgggcaaaggacatgaacagacacttctcaaaagaagatttacaagcaactaacaaacatatgaaaaaatgctcatcatcactaatcatcagagaaatgcaaatcaaaaccacagtaagataccatctcacactatggctatttaaaacttttaaaaataaatgctggcaaggctgtggagaaaagggaatgcttatacactgttggtgggaatgtaaattagctcagtcactagggaaagcagtttggagatttcacaaagaaccaaaaatagaactaccattcaacccagcagtcccattactggatatacacccaaaggaaaataaatcattctgccaaaaagacacatgcacccatatgttcatcacagcacttttcacaatagcaaaaacatggaatcaatctaggtgcccattaatggtggactggataagtaaaatgtggtgcatcatcaaaaagcttatccaccacgatcaagtcggcttcatacctgggatgcaaggctggttcaacatacgcaaatcaataaacataatccatcatataaacagaaccaacaacaaaagccacatgattatctcaatagatgcaggaaagaccttcgacaaaattcaacagcctttcatgctaaaaactctcaataaactaggtattgatggaacgtatctcaatataataagagctatttttgacaaacccacagacaatatcatactgaatggccaaaaactggaagcattccctttgaaaaccggcacaagacaaggatgccctgtctcactactcctattcaacgtcgtattggaagttctggccagggcaatcaggcaagagaaagaaataaaggtattcatataggaagagaggaagtcaaattgtctctgtttgcagatgacatgattgtatatttagaaaaccccatcatctcagcccaaaatctccttaagctgataagcaatttcagcagtctcgggatacaaaatcaatgtgcaaaaatcacaagcattcctatacacccataacagacaaacagagagccaaatcatgagtgaactcccattcacagttgctactaagagaatcaaatacctaggaatccaacttacaagggatgtgaaggacctcttcaaggagaactacaaacgactgctcaaggaaataagagaggacataaacaaatggaaaaacattccatactcatggataggaagaatcaatattgtgaaaatggccttagtgcccaaaatattttatagattcaatgctatccccatcaagctaccaatgactttcttcacagaattagaaaaaaacttctttacatttcatatggaaccaaaaaagagcccgcatagccaagacaatcctgggcaagaagaacaaagctggaggcatcatgttacctgacttcaaactttactacaagtctacagtaaccaaaacagcatggtactggtaccaaaacagagatatagaccaatggaacagaacggaggcctcagaaataacaccacacatctaccacaatctgatctctgacaaacctgacaaaaacaagaaatagggaaaggattccctgtttaataaatggtgttgggaaaactggctagctatatgcagaaaactgaaactggaccccttccttacaccttatacaaaaatcaactcaagatggatcaaagacttaaatgtaagacctaggaccataaaaaatcctagaagaaaacctaggcaataccattcaggacataggcatgggcaaagccttcatgactaaaacaccaaaagcaatggcaacaaaagccaaaattgacaaataggatctaattaaactaaagagcttctgaacagcaaaagaaactatcatcagagtggacaggcaacctacagaatgggagaaaacttttgcaatctatccatctgacaaagggctaatatccagaatctacaaagagcttaaacaaatttacaagaaaaaagcaaacaaccccatcaaaaaatgtgcaaaggaaatgaacagacacttctcaaaagaagacatttatgcagtcaacagacatatgaaaaaatgctcatcatcactggtcattagagaaatgcaaatcaaaaccacagtgagataccatctcatgccaattagaatggcagtcattaaaaagtcaggaaacaacagatgctggagaggttgtggaaaaataggaatgcttttacactgttggtgggagtataaattagttcaaccattgtggaagacagtgtggcgattcctcagggatctagaactagaaataccatttgacccagcaatcctattactaggcatatatacccaaaggattataaatcattctacgataaagacacatgcacacgtatgtttattgcggcactattcacaatagcaaagacttggaaccaacccaaatgtccatcaatgatagactagattaagaaaatgtggcatatagctgggcacggtggctcacacctgtaatcccagcatattgggaggctgaggtgggcagatcacgaggtcaggagatcaagaccatcctggctaacatggtgaaaccctgtctctactcaaaatacaaaaaattagccgggcgtggtggtgggtgcctgtagtcccagctatgttgggaggctgaggcaggagaatggcatgaacccgggaggcggagcttgcggtgagctgagatcgagccactgtactccagcctgggtgacagaatgagactccgtctcaaaaaaaaaaaaagaaagaaaatgtggcatatatacaccatggaatactatgcagccataaaaaagaatgagttcatgtcctttgtgggaacacgcatgaagctgaaaaccatcattctcagcaaactatcacaagatcagaaaaccaaacaccacatgttttcacttattaagtgggagttgaacaatgagaacacatggacacagggaggggaacatcacacaccggggcctgtagggggtggggggctaggggagggataacattaggaggaatacctaatgtaggtgatgggttgatgggtgcagcaaaccaccgtggcacgtgtatacctatgtaacaaaactgcacattctgcacatgtaacccataacttaaagtataatataaagaaaagaaagaaaatatggtgcatatacaccatggaatactatgcagctataaaaaaagaacaaaatcatgtcctttgctgcaacatggatgcagctggaggccataattctaagagaactgatgcagaaagagaaaaccaaatactgcatgttctcacttataagtaagagctaaatattgggtacacatggacataaagatgggaacaagagacagattataagtggggtgaagtagggaggagcgcaagggttgaaaaactacctattgggtactatgctcactacctagatgatgggttcaattgtactccaaacctcagcatcatgcaatgtacccttgtacaagtctgcacaagtacccactgaatctaaaataaaagttgaaaaaaaaaaaaacattaggttaattaagaagagaatggagaaaggcagagggcaggtcttagcatggtagaaaattttaaacagcaattaagaaataaggtgcttggccaggtgcagtggctcacgcctgtaatcccagcactttgggaggccgaggtgagcagatcacctgaggtcaggcgttcgagaccagcctggccaacatggtgaaaccccatctctactaaaaatacaaaaaaaaaaaaaaaagaaagaaaaagaaaacatctgggcgtggtggtggcacatgcctatagtcctggctacctgggaggctgaggcaggagaatcacttgaacctgggagatggaggttgaagtgaaccgagatcacgccattggactccagcctgggcaacaagagtgaaattctgtctcaaaaaaaaaaaaaaaaacaaaaaagaagaagaagaagaaagaaagaaggtatgtaaagcaaatattgacagaagcaaaaaaagaagaaaaagaaagaggagtcatgggacttgtcccagcagggtggaaagctttagatggttattaagaagtgggatgaataaaatggatattgatggattaaaacaaaggatttaacacagcactaccaaaggttgagcaggcccaagggaacccctgctggtccctcaacattaaagggttccaaataagcctgctctatttactccagtttggagaaatttaaaaagccaaaggcaaagtttatcatgagaaacctgaccagcaatcactgtgacagttgttagcaggttcatcaagatgaagattgacaaaagggtcacagtcccttggctctaccccttctcagtggagacccaaagccttatgcacatcagtaggtaaaatggtcagcggtgggggcagtgtggagaaaagattactgggactcaatacaggagcccccagcactgtggtaccaaaacccattgatgaagccctgaggcaggctgcagttagaatgagggaaccgtaaaaggtaagggtttataggatcatgaaaggtggaatgtttaaacagactttaggtaaagctgtgtgtcctttacctgaatgttttatgggaatggatattacatccggctggggaacacttttttgagatggagtctcgccttgttgcccaggctggagtgcagttgcacgatctcggctcattgcaacgtctgcttcccgggttcaaatgattctcctgcctcagcctccccagtagctgggattacaggtgtgcaccaccacgcccagctaatttttgtatttttagtagagacggggtttcaccatattggccaggctaatctcaaactattgacctcaggtgatccacccaccgcaacctcccaaagtgctgggattacaggcgtgagccacgaagtccggcctaacacttcttaatacctagtattgtaacaccaaaacctgttaattaagtcctaatggaggccgcagttagggatgtagtggttgatggaattaaagtctgtaggcgaattggtgtttttcagcaggcttcgtgagaagtgcttgcgtgcgtctcttacctgattgtattatgggaatggacattgtgtctgcgtggggaatgtttcccctacctagcattgtaaaacagaagcgcgcagcacttcaatcatcagtgtggagagcgttcttagaggtcaccggtgtggaagctgaggcttcctcaccttgcttcccctgcaccacactgcagaggccaacacctatttcttattaggtcacagttctctcagcaggtgaggcattaatggccaagaaaaagaaaggatgagaatacaatcatgaataagtctagcaagggaaatatttttaggtgtttttattattttttattttttattttttatttttttgctctggaaactgttagtccaaactgcaccattttgtaaccccccagccatttcgcagacctcggtcaaagtgaaacattccacaggggttcgggctgtgacaaacagcctgcccaaccgcttgactctcttattatattctgctggaagaaagtgtaaggaacctcacactgcactggaacaggcaccaaactgcctaatcatgggaacatgttatcaacattttcccaggcagcaggccatgccccctgttccagacccctcccacctagcctataattgccccagcctgtaagtggcgatggccattggcattaagctgcaggtcttatgctggacataaagccggcatttgctgtaaagccaccactctctctctttgtgtctttctttaaccctagccttcccttcaaaacccaacaaaaactatttataagacaatttttcttcatcctccagtaagaacctaattttttgtttgtttgttttggtttggttttggagttttttgtttgtttgagacaaggttttactttgttgtccaggctgaagtgaagtggtgcaatcatgactcactgcagcctcgatctccccgggctcaggtgattctcccccttcaacctcctaagtagctgggattgcaggcgtgtgctaccatgcttgggtaatttttgtattttttgtagagatagggttttgccatgttgcccagactgatcttgaactcctgggctcaagcaatcctcctgtgttggcctcccaaagtgctgtgattacaggcgtgagccaccatgcctggcctaagaacctagtttttggacaactatgaaagtgctgttttacataataggatgtagacatgtaataattcataacacctgaagggggcacaggcaaaaaatataaagaaaattgagaatgactggatatcatatctaatggtgccacatttgtgtctaacatctttgacattgttctcagcaaatccctgggaatcagctgttgagctagatggagatgggaagaggataaagactgagatagatggctgggcacagtggctcacgcctgtaatcccagcactttgggaggccaaggaggatggatcacctgaggtcaggagatcgagaacagcctgaccaacatggagaaaccctgtctctactaaaaatacaaaaaaaaaaaaattagccgggcgtggtggtgcatgcctgtaatcccagctacttgggatgctgaggcaggagaatcgcttgaacccgggaggcagaggttgtggtgagccaagtttgcgccattgcactccagcctaggcaacaagagcgaaattccatcaaaaaaaaaaaaagacttggatagttgtattatatctattaattctaacaggttgtggagaagcttggcatgaaaatcatgaggcataatgaagtttgtgtgttatttccagattgttcttaccatgttgttaagtcatagatgaaaacaagcaatgtttgaaggatagtcccaacctccaggtgtacctaatcctgatgaagccgatgctgttagcaccctcccatatccctgggccttttagaattttcagttgatttccaactgtcagtatttgtacctctgtacctgcagccccttttccttggaaatatgtgttgcttatttgcaaggcaaaccggagtagcaaagaattaacaccccccaaagccctacaggcagatccctcaaccaacggctctcaggagttgatgtataaatgccccagctccttgtaccttgggcagaataattctgtggtgtgggttttgcaccattcctagaagttttcttgcaaggttgagctcaggtgcccactgtggtagctggctcggtgacacgttttattggctgtcctactgtccctgtatcatccagccacctcatacgagcgttccaaaataaactacccacactggaaaccttgcctcaagttctgcttctggggaaccaaactaagacaacttgaatgtgaggtctcccatgggacatctcttgcatcctagtcataaagagaacactgggggaatacattcagggaacacgtgagcgtactatttcttgtttttcaaattacctgaaagtgatctcatctagatgtactttattgttgaagtagtgacattgaaggggctagtgattagatgaaattcatgcatgtgagggaaagcccaaaataaatcattcctgagcaaagtgaacatctgaagagcatcctggatggcccacatgcagggaggataataaaaatatttaacacctggtacagcatgggcctcaaccagtcatagaagctgctggcctacctgctaagggcctgccacacaaactgaccattggccctgcccagtgaaacaaggattcctggtgctgcctgggtcaaatattcaggctgggttgagaggtcagtgggcaaagaaggatttacttggctttctccaagagggctcagaggcaggtgtgtatgattttgattccttctcagaaacagaagtgatggactgaaacattcattgaacatctccaaagggagttaaaggcccagcagggccacagtgtcacacgtccactttacactccaacgtgttatcacttgtgtcctctcctgactatggaagtaaaggccacaaacagcacacagtttccttccagagagttgtctcttctccattgtaggtagtgtgagcaagaccaaggtagcaaaatagccaaagggtaggtttgtatgtgacccaagataaatagctccgaacctctcctggcactatgaaagtgacgcagaatgaagacataatcagaaacaggtgtttggagtacatatatgaggatactggtgagggtgctaattcatttgcttactatggatgctgtaaagtatggttaacccattcctgctacccagaccccagagttgcctggtgtctcttcatctccttgaccttcttagtttgttctgttagccttccagtaatttctttttaatgcttaaaatttctataagtggttacttttgcttgcaaccaaagaaccataattgatttgggtcctacatgcttatcttcagccatgttttgtgagggatggaccccgtgaaagaaagcgtgtggcagcaactgctgaaaataagaaaagccagtccctggatcttcacagacaaaagaaaacacaggaggttgctgtgggtttgaaggacttggtgtatctaacttgaatgacagcttcacctcagttggctctcagtttcccatgaagctagaattccatccctatttcttccattgtcccatggattggctggcttacgagtcaggaacttctcataagcaaagcctgagggctctgggcagatactggaaaaaagacaaaggctcgggtaaggcttacttaacttgttagcaattctggtagacagggagtaggtgggcattggaatcacaggctaaaatgaagcctggctggaatacctagggaccatttgccatgatattcacatttactgcaaagtaattatatatatgtctatgtccgtttcctaggaaccatattgtgaactggatggatttcttttatttttctttccttttttcaatgcttattttcattcagaaaattgggaaatgaattttctttcatgattttaatcatttctttgccagtgttgtatacaacacattcacgtaaaactctcaaaggcggccatctgagcactctgccaacctggcccacccacagagctttgcctagaagctttgtcttttatagaacttagctcgagcaatgatatcattgacgaagtcattgtctatgtccgatggggtggcaatcgcttcaattcctgacttaaaagctgagagaccacctgaaatgaaacacagagaattaggctcaaatattaactttcaacagaaataagcaatgagcattgccaagatgttagctttccaggcaaatcttccaaagcaggcagtcccaaatcctcctccctctccctccctttctgaaaggacgtgctatcccaagaatcactgggaaaattccagattgctttctttctctttttccaaagtctttggtttttcttgttgcaaaaatcagatttgcttttttatgtaatccaggcctggcagaactagactcccagtacatcctctgctgaaaatgcttgtaacattctctcatttattcaataattcactcatctattcactcactcatttattcattcaggaaatgttttcaagcacctactatgtgccaggagaggtgccacactgactgcaaggtacccaagacacacttatttctttgggtatgtgtacatatgcatgtgtgtgctattttaccctagaattttatctctagtagttatgtatgtgtttaacataattgtgctctgctctgatatccagagaggaagatgcctggtcctgatccctgccttcaaggaccttgaagtagagactagaaactgttctgattaaggccgttagagtgtggaggacataacattggccaataggaggcaaacctaataggaattgatgtggttgggtgtgaagagagaaggaaccagagagcctaagaaagcaatctggttttcaggctgggatgactggctatattatggtgcctccaagacatgtaaaatgcagaagaaagagcaaatttatagtgggaagttagtgagttaattccatctgggagatgctgaacttgagggggcctgtggtcagccaagcagagatttccacttggatatatagcacctgaagtcccgaaaatactcacagagtaacattgttcagacaatttggaaagttgttgacagtttcttataacaggaaaaaacctatgagaggtaggcaaacagatagatagatagatagatagatagatagatagatagatagatagataaatttttttttgagagatggggtctcactctgtctcccaggctggagtgcagtgatgtaatcaatgctcactgcagccttaacctcccaggcacaagcaatcctcctggcttagcctcctgagtagctgggactgtgtgtcaccatgcccagctttttttttttttttttttttttttgtagagacagggtctcactatgtttcaaggtatcactcaatagctcagtaagcaatgaataagaaccccaacattctgcagaagaggaaatggaggttgaggatggaggacctctcaaagtaactcagtggttcagggaatgcaaatgcagcctctagacagctcctcccagggccactgctgaccccgtggaaatgctcccagggagtctcgggtcacactggccttcagtggtctcattcattgctcatttaaacaaagtactcagaatacagcctacctttgaggtgctgagcaacactccacgtggggaattttttctggattgccttaattctctctgttagaatcccagtagcctgtgaaaggtgctctttgctatcccaggcaccgacagggtggtacgtttgtttatcaagctagaaaattcagataataaagtcagcatctggatgaggtaacacattttttctgccattcctaatttcctctcctggtattcaagtcatagataccggcctttatccccaaagagtcaattctattgttctttctttcatatagatgagagtcagagaaacaaagtaaggtttgggagaaatggacatggtatagttttagctaaacattctaatatacaaaaaaaaaatttaagttgttttgaaacaaataacacccaaagtctacacatttatagtaataaataattatccagctaattcagataaaaatttgtttctaactgggaaggccagaagtctgtatttctacagacaatttaaaatcgagcctggaagcaaatatccagataatttggatccccttcctccagtttacccaaaggaacaagttgtttcaagtagggcacagttataccatgttttgatccacatggatgaaatttactacttcatgaaccccaagaggacacctgtaacaataatgctatttataagattttctcagttttagtgtattacatattatttattgcagaatggtagttatgaaactcctaaaatactttttaaaatatatctaataatgaataagccttgaataaaataaaaagatgtgttacagaaatcccagatcaaattatgctggagtggccgggcacagtggctcaagcttgtaatcccagcactttgggagactgaggtgggtggatcacctgaggtcaggagttcaagaccagcctggccaacaaggtgaaatcccgtctctactaaaaatacaaaaaattagctgggcatggtggcgtgtgcctgtaatcccagctactcaggaggctgagggaggagaatcacttgaacccgggagtggaggttgcagtgagccgagatcacgccattgcactccagcctgggtaacaagaatgaaactccatctcaaaaaaaaaaaaaaaattatgctggagtacctgtagccagatgccagggtattttggggcttggaagcactgcaaatggatttctagttcaggttgagcttctgtgaggagggatgcagtggggctgatagaaagtttctagctaaatacctgcatcaagccaaatttaagtcccctgtggtcccagccgtcttgcaggacagatccgccatggctttccctggagatgatggctgcgatgacagcagggtccacgcaatgtctctgcccgacttctttgatcagagtctggtaaggttttatggccctcaaatccatctcagcaaacatttcagaaccacggatccctacgtcaatagaaaagaaactgtttttccgggcatggtagtgtgtgcctgaagtcagttcctgctacacaggaggctgaaacaggaggattgcttgaacccaggaggagttcgaaaccagcctgggcatcatagtgagagcccatctctaattaaaaaaaaaaaaaaaaagaatttaaagttaaaaaaagaaaagaaactgtttcttctacttcagaagaaaaccatttttaaaaatttgctaagttagccacagcctctgatcactgctaatgacttgggacaaccattctaagacatccttttgatctctgactgcagaaacaaacagatccacaacccccaacaggtgtcgcttctgctctgtttctccttcaaattgctcatgcctgtaatcccagcactttgggaggccgaggtggacagatcacttgaggtcaggagctcaagactagcctggccaacatggtgaaaccccatctctactaaaaatacaaaaattagctggacttggtggcaggcacctgtaaccccagctactcaggagactgaggcaggagaatcgcttgaacctgggaggtggagattgtagtgagccgagatcatgccatcgcactccagcctgggtgacaaagcaagactctgtcatacacacaaaaaaaattctgccacactagtgcactgggaagcctgttgtactaggagttagccaatgcatgttttagcctggctccgccactagttggttctgttctattgggaagtattcccctccttgctgagtctttgggctctgatttgtaaatttgaggggttggggtctgatgtgaccttgtggttgctgccagctccgacactctaaaaccaggataacgtgatgaagacgactttggaacagtattgcttcaaatggtcatgtgtaacatgaagcaaacacagcagcaccacccaaaaaacaaagccagagtctaatatttattcaagcagtagtttcaatacatggaaataaacacagctggacaaagtttggaaagaatgggggtggaaaatgaaaagaagctggttgttagattggtcaggattgtggtttttgctcatttttaattttgatactattgtcataatgatgattataccttttcaaaattaagtgacttcctaagaaagaatctgaaaacgatgaaagggggaagccagtcatttgctctgcttttcacttaccgcagttcatcacactgtttgcatcacaagtggccccagaggtcttcatggtcatgatgtccccatagcagccgtggtacaggcgtggatgtaggtgaggcttcattgagtgactgaaggggtatgagcccctggaagtgcctaggaggcagaagtgtaactcacatgaatcctctgagaagatattacttgggttgctgcaataaacatcactaaaccaaaggcagaaggccacagacagaactccccaactctcttgttgccattatttgttcctcagacagaagttccccatgcccactctgctccgatcttttgttttgttttgtattaacacaggacgtaatctgaaaactctatgcaaaatattatgaaattcatctcttatagatcctaaatacatgtgcagtctttttttttcctttttttaagagacaaggtcttgctctgttgtccaggctggagtgcagtggcatgatcatagctcgctgcaggcaccaacacctgggctcaaactatcctcccaccccagcctcctgagtagctggaaccacaggtgcatatcaccaggactggcttattttctctttttgtagagatggggttttgctatgttgcccaagctagtctcaaactcctgtgctcaagcgatcctctctccttggcctcccaaagtgctgggattacaggcactgtagtcataccatgctctatgtcagaattaaaactgacaggtttttaagcaggaaacttgagagttttttttttttttttaagattcagggggtacatgtgcaggtttgttacgtgggcatattgtgtgatgctgaggattggccttctattgatccttcacccaaatagtgaacacagtacctgatgtgtagttttcaacccttgcctccctaccttcctccctccctccttccttttacagtccccagtgtctattgttttgagaggaattttaaaacatttctgacacaaatgcctctggagatgtgaacatctagattaacaatttgcctttcttaagccaaaattgacaaatggggtctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaagtacatgaacagacacttctcaaaagaagacatttatgcagccaaaaaacacatgaaaaaatgctcaccatcactggctatcagaaaaatgcaaatcaaaaccacaatgagataccatctcacaccagttagaatggcaatcattaaaaagtcaggcaacaacaggtgctggagaggatgtggagaaataggaacacttttacactgttggtgggactgtaaactagttcaaccattgtggaagtcagtgtggcgattcctcagggatctagaactagaaataccatttgaccctgccatcccattactgggtatatacccaaaggactataaatcatgctgctataaagacacatgcacacgtatgtttattgcggcactattcacaatagcaaaaacttggaaccaacccaaatgtccaacaatgatagactggattaagaaaatgtggcacatatacaccatggaatactatgcagccataaaaaatgatgacttcatgtcctttgtagggacatggatgaaattggaaatcatcattctcagtaaactatcaccaaggacaaaaaaccaaacaccacatgttctcactcataggtgggaattgaacaatgagaacacatggacacaggaaggggaacatcacactctggggactgttgtggggtggagggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaaataaaaataaataaataaaattcaaaaaaaaccaatttgcctttgtttagaaagataagaaagaagggcaccataacaatttaaatatattcttattatatatcatttactgtgaagttgagttcctatgtatatttaataaaattagaagtaaaaattgaatttgccaaaataatttaagtcaaatctattcttgtctttttgttctgtcattaaaaagtgaatttctgtccaagtctacctgttacaggagaggcagagcttttgctaaaggagatacaaagttattttctgtaatgttgaaaagtttgttctaacggtttcaaggactgttaacttgtaccttaagagtccaaatatttgttataagacagtacttagggctggatgttgtggcttatgcctagaatcccagcactttgagaggctgaggcaggacgattgcttgagcgtaggagtttgagaccagcctatgcaacatggcaaaactcatttctacaaaaaatacaaaaattagcctggtgtagtggcacatgcctgtagtcccagttgcatgggagactgagacaggaagattgattgaacccgggaggtcgaggctgcagtgagctttgatggtgccactgcactccagcctgggcaacagaacaagaccctgtctcaaatctcaaaaaaaaaaaaaaggattttgttaaaatgtttgatgtaaaaaaaatagaatctggttgggcgtggtggctcacacctgtaatcccagcactttgggaggccaaggcaggcggatcacctgaggtcgggagttcaagaccagtctgaccaacacggagaaacccatctctactaaaaatacaaaattagccaggcatggtggtgcatgcctgtaatcccagctactcgggaggctgaggcagaagaatcgcttgaacccaggaggaggaggatgcagtgagccgagatcgcgccattgcactccagcctgggcaaaaagagcgaaactctgtctcaaaaaaaaaaaaaaaaaaaaaaaagaatctaaccacttctcccacctctgcttctgccatagtcccagccagcatcattgctcatctggactctcctaacagccttctaactgacctccctgattcactcttgcagcccatcctctacttagtagacggagtggccctgtgggaatatgcatgggctgctatcagtcttctctcttaaccttccagtggctttctcctcctttaggggaatagccaagtccatcctgcagcctccaagacctactagatgtggccctctgctcctgttcctacttctctttccctttgttcactctcctccagccacattcttctttgtgcttatccttcaacatgccaggcaggtttctgcctcaaagcctgtatgtttgtggtcccttttgcctagaatgctattcctcctggtatctacatgatcatgccttcaggtctctgtccaaatatcaccttatcagcagaatatatagcgagtttatagacaaaaaaagaaaatagtccttaaacatataaaagacgttaaaccacactcaaaagaagagaaaggccacattaaaacatcattataacagcattttccaactctttttttttttttttttttgagacagagtcttgctctgtcgcccaggctgcagtacagtggtgcgatcatggctcactgcaagctccgcctcctgggttcatgccattctcctgcctcagcctccccagcagctgggactacaggcgcctgccatcacacccggctaattttttgtatttttagtagaggcggggtttcagcatgttagccaggatggtctcgatctgctgaccttgtgatccgcccaccttggcctcccaaagtgctgggattacaggcgtgagccaccacgcctggctgcattttccaactctttagttggcaagagcccaaaggtttggcaataccctctgtgggagaggttgtgaggaaataggctgtcacacacattgctgtggaacacagttttgtgataggctgttcattccagcactgttgataagagcaaaggactgcaaacaacacaaatgtcattaatttagggactggttgagtaagtgatgctacgtccacagtggagcactatgcagctgcaaaaggaaagaataagacctgtatatactcctgtaaaattctctccagggacaaaatagtatttatagaattgtactctttgtgtaagaaaggtaagaaaatacaatcgtatattttgtgtgatttgctcatattttcaaaagaaacaatacaaggatgaatgaaaaactgataaaaattgttagttatggagagagtaagaggaaggtaaagggaacagggataggggatagactaactatcttttttaaagtttttattttggaaccatgtaaatgttatcataaattttaaaattaaatcaaatggggaaaaatggaatcataaaaaagaagaacaaatgaacataactctataacaaattgaaagattaataaacacatagaggagaattatcttaagtgactttaaaatatatccatataagtctataccactacataggaatccatcctgtgaacataaataatcacaagaaaatcttaaattatatttactgtctcattgttggttggtaatactgtcatacttattttgacactattgtatgtaaataagtaataatgctaatgtcattagaactaggatttttagtgtaagatagcagaggtacaaatataaaactgatgtaaaatgcttgcattcttaaatataaatgtgaaatatctgaatgcatagttgttttccttttaaaaatatatattttctagttcctgccactgaaaacacctgaaataaacgacagctccatagcaatggagcacttttacttcccacactgtggtctctaaataccatttcctgctaagtggaaccagcgctcctcagaataatggctgattgcctgcctggggcaggaaatgttcaagatgaaccaggaacatctttttgtgccagagctggtccttatatgttagagacacattaaaaaaaaaaatttttttttccagatggagtctcactctgtcgcccaggctggagtgcagtggccattctcctgcctcagcctcccaagtagctgggactacaggtgcctgccaccacacctggctaattttttgtatttttagtagagatggtgtatcactgtgttagccaggatggtctcaatctcctgacctcttgatccgcctgcctcggcctcccaaagtgcagggattacaggtgtgagccaccgtgcccagcccaaaaatttttacaggtgaaatgtttttatctcactgcaagctccgcctcccaagttcatgccattctcctgcctcagcctcccaagtagctgggactacaggtgcctgccaccacacctggctaattttttgtatttttagtagagatggtgtatcactgtgttagccaggatggtctcaatctcctgacctcttgatccgcctgcctcggcctcccaaagtgcagggattacaggtgtgagccaccgtgcccagcccaaaaatttttacaggtgaaatgtttttatctccctcccttcctctcactctttccctctctcttccctttttcctctcactctcttactgttcgttcctctcactagaagataaatttcattaggtcagatactagatgtttttctctgctatatcctcctcagcacctggaacaatgcttggcacaaagtagacatttaataaacatttgctgaatggaagaatggatagttggatggatgaaggaatgagacagaaagggattgtttaaattatctggatcaagtgtccttatattgacaggttcagtatcctttcactgggaggcagtctttgccaggctcactgtgtggcccacagaccacaggcatcaaagttacccaggaagcttattaaaaatgcttatcactgggccgggcgtggtggctcacacctataatcccagcactttgggaggccaaggcggacggatcacgaggtcaggagatcaagaccatcctgggtaacacagtgaaaccctgtctctactaaaaatacaaaaaaattagctgggcatgatggtgggcgcctgtagtcccagctacttgggaggctgaggcagaagaatggtatgaacccaggaggcagagcttgcagtgagctgagatcgcaccactgcactctccagcctgggcgacagagcaagactctgtctcaaaaaaaaaaaaaaaaaaaaaggcttatcactgggcttttcacaccagatctactgcaccaaaatcttgcagtataaggcgaaagaagctgccttttacccagcattcccagttgactcttacacatgtttatgaaccactgctttaagggaactggaatatgaccatggaccctacgctgcctgtgtaggccttataaacacacaagccctttttaaattaagagtcacctttcagctatacacagctaatatggtagctcataattaatctactggctatttaactctgctctcacctggcaatctaaaaagagtaaaaatttaaaactatgttgccctgttttgaccataagtaactggaaattactttcgggtagccttgtttttccaaatttagaattaaacattttagaaacactttcctttcagtcaccattctataattaaagacaacttgaacattgctcataatggcttttcattttgcttaggtcagagttttcacattctcttattcaagatcccttaccaacttaccaacctatctttccagccttccccccagaaaccccctcgtctgtccagaccacactgacccaaagacttttcattcatttctgcctctgcttttttactgaaatctttcttcccatccagcaggctcttcctttttcttattaaatcaccaagcatccttcaattgacatgtcccccccaaaagcctttcacatctgagcattctagttggatgtgagctcttcctcccaaacctttcccagactagtgcttttttcccacctatacacattgaactctcatccactgcttggcattgataattgtctcttcatgtgttttgcttccaaggcactgttccatatacctctcggtaaggtatccagcctgataggtgcattgtcagacaggaagtaagcagatcaataaatattagattatttgaaattcccatagatcctgtttttcacctgcttagcaagcagaacacactgttaattatagaaataatagttgattaatggccaagctggtcagaatgagagcccactcttccattacaggtaatcattgctctttctgattcatgattgtgctggaggtttttgtggacaccctgtgaacaatgctaaatctcagccagtgacttaccaatgagggcaattagtccccaaaacaccacggaggataacatggcggggaatcttatcttccaggacctgctctgatttgaaatagaaactggttaattttaaaacctgaaaatttcctaaagaaaaatttgctttgatattttaaaaagtttagagttatttccaattcactactcatttccctgtttcaagatagtattctcacaggctcagtacatagtttgttggcacactctctttcttaagcataaactcctaatctcacttcaatccaatttcatattgacatgagtcatgcgtatcttacatatgtaactaaatatacactcccatcccacctctaagcttggtaacaccacaattttgttccctttctttttaaaaaaaaaaatactgatcttttcattctagttattcaccctacccctggcttcaaggatcagttttggtctttcattcatttatttagaaatgggatcttgctctgtcacccaggctggagtgcagtggcataatcatagctcactatggcctcaaactcctgggctcaagcgatcctcccacctcagcctcctgagtagctggggcgacatatgcgtgccaccatgcctgggtgtttccattcttataccagggtctccgtagggaaaacaaaataaaacaaaataccaacaggagcatgagaacgtgacttagaagaggtttcctctgctccatttcttcctcaatcaactctattcttggtttcattcaaatggtagcttataagttttacaagacataagaaggccagcactaaccttgtttgcaaccttacagagaaaatctcccctctctgtttgcaaaggtcttctgtactcagcagcaaactgcacttcaagcttttacaaagcgacggcctttgtcctgtaacataggcttaacaattggagaatccattagtcagtagatcactgcgcacctggcttcaacagagtagacatcagcgtggctctactgctgtggaggaaacttttaaacaccagcatgaagactcacctggcttttcttaccttcgtcctgtaccaatgatcattagaggagctttatatatggtttaaaaccctctctttaaaccattgacctcattaggcctggttataatagtacttaggacttaggtgacccaattaataagaggatttcaaagggcttattaaccactattaattaattaacctaatgaacccccaagttgctcaggaggcatattttgatagattgtttctagatatctaaaattgtgccaaacagcttctaaatttgcgaataagaaacagataattcactttaaaaggataacaggaaatactagcaatttttattcttggattggttatttacctgaaatattgggtctcctgctttttgttcccattccaatgtcatatgatccccgtaccagtatgtcacatgatctcaaaccactatgtcacatgatcatgataggtgaacttggctccttactccaatcccacttctgagaaaaaggtgcaagtgtggccacctgctctaggagatcaatgcaaaaccagggagtagcaacgtgagtgctcatttgcccatacttgctaaggatatgggaaaaaagattatagccagggatgaaaacttcttcaagaagagagtatctttcttcaggcttatgtccaaaggaagagaggaagcatattgtgcagccccaggaacaggaaatggaagggacgttcttgaaacaggcaaagcacattgcgctgaggggaggaagaagtctggtctgggtccttccacaagcgtgtccagtttctcagactgcacacagtcctcccccacatccactgagtgaagaaaggtggaaggcagctgtacagggaacaggaagacaaaaccacaggcaacttcccagctccctggcaataaaaccacctccactcccaggagaacatgccctccccaagctgaggtctgcacagtccactggcattcacttctgccctgcctgccttcctgcttgtagaacagacgtctctggcatggcctctagccttccatccctggaagagtggcagggctgttctgagccaatggatgattcctacctgactctcaggaaagtgacccatggagggtctgctccaccaccatcaacactgcagtcaggaccactcttgaataagggatattgcaggagtctaactgccctgaggcaggccttagaaacccatagtctatgacccagcgacattgtgcccgtgacccacttcactgcagggtgagtagagccacttacctgaggcttccaggctaagtgcaatgagaaagctcaagaaagggagattaagaagttacgaatgataagttaggtaaaagagagtaggtggaggctggggctctccctacatgcactggaagaagacattgttaataaaacatttaaagcactgttgaatgtgaagaatacttatccttctgctctcagttagtggggctacgagtccttctaggtatgaggtccttaatgtccaggcttctgcaactcaaccaaaattgttttcaaactgatgtggattgttctgttcactcaagctgtgagagaacaattgaacatttatttgacacccaacattagtcaggttcctatggatattatatgactcaatcctccactggccctgtgaggcaggtattatcccttattttagagatgaggaaactgtgactcagagaagctaagtaacttgtcaaagatggcacagttagcatgtgacagagccaggatttgaatctaggcctgtaagattccaaaatccatgctcttccactgtatcgaagtgccagcacgatggacaaatgcctctgcagagcaatcattgcaacaggtccaaatcaatctggatacaaagcattgtccgtggtctggaaaaataacaccactcacagatttttataccactatctgtcaaatgtttgtaggtgctgttgtaatttctaaaatgcaaattaatataagttaactaagtccaaagtggttttttgtcactttatattttctccaccagtaataataatgtagttaatacgcactgaccttgtatggtatgactggtagaataataggaaggggcataacctaagtttgttacattctgaagcctaactcttaactgcagtaccctactgacccagtggatggttaagtgtgggtactattgtataatgaccttagaaatttcttgtcactaagaagaaatgtactgaataattctccatctcttcccagggataccaagaatgactacatgtaagttgtactgttatttccaggaggggcttgaagggaacttggcacctgtcataatctctatcagtccccaaaataaaaacacaatctatatgcaagcaatttctgtgctatacaaataaaactctatggcctggtcccctacccctcaaatcagttgcctgctcctaagactcttcagtgcagcaattctctggcagcttctggggagtcctaacagatttggggttcctggcttcagtggtggagactccaatcatccctaacgactaaatggcctcagcaattggaaaacttcaatgggaaagtttaagcagtactgtcctagttaggaggagaggaatgattatgaaaactgaggtactctgtatagccagggaagtagattctggtaggagttcctggcaagacttctcaattcataccacacaaagacctgcccttgtgccctgagctaccctaggttagcacttttgggagttaaaggaatccagcacctcaggctcccttggtcccctcgccctctgcgtccccacctgcctccctcccaacactagtctgtgctaatagagactgggttgtctccgccatgtcattatttgtgaatcccaggcacagctttcccttctcaggaacaacagccaaggaggatgaccatagccaactcatttaacctccctgagccttaattttcctcatctgtaaaatggagatgataataatgccccatgactttgttttgaagacaaaaataaattttatatgtaaaaacatgttataaactacagtgcttcatagagatgccagttactatcatgatgggtttgcactcaagtcctgatggcttagcttcttgttgatttattcatttgtttgtttatccatgcactcaggaaaaataaacagctgaattataggacaggaagtaggaggtgaagtctctctccagccatgaagaaaacttggcaggacaagcaagagctattcattgtcaggactctgtagcctgcctggtaggagtggaggaaggataagttcagaaacagccacacaagcagctgcagcccaagcatctgtttcacagctctgaaacctataaaatgggggagctgcccaagaatatgtggcaaaggtactttggcgccaatggctggtaagaaggcagaaggggagcccttccataaaatttcactaaaacattcaacttaaccccaggatatatcaatgtcaagctttaactgctgtgtgcttttcttgtcttggttttaatctactatatgataggtaaaatgcagggtatgccctgttgaagaagccacttatatggttgcattattggtcttccaatgtcaaacatttgaccaacatttcaggaaagaagatatacaaatggccaataaagctcatgaaaaattggtaaacatctttacacatcagggaaatgcaaaataaaaccaaaatgagacagtatttcacactctctaaaaaggctaaaaccaaagactagctatatcacatattggtgagaatatgaaacaaaacagaactctcatacattgctggttggagtataaaatggtatgattgctttgtagtactgttcagcagtttctaacaaagtaaataactatatgcctcaggaattttatttctagttatttacccaagagcaatgaaaaaaaaaaaaatgtctcccaaaagacttgtatgagaatcttcacagattgtaagttctgcaaagagaaaagaaaaaaaaagaatttttacagtgctttattcataatagctcaaaactggaaacactccaaaaaattcatcaacagaagaatggactaacagttgtagtataacgatataatggaaaaatacacaagttaaaaaaaaaatccaggaaaaaattccaatgaacctgggctgggtcaggtgcccacctctggatcattcaaccatgtctaggaatatatttgtttgaaaaagggactccctgtggtttggaaaggagaagggagaagtctgaaacaaaattttaaagtaacgttttcattttgaaatagtttaaatttcacaagaagcttcaaaaatagtaccaagagttctcatgtacccttcacccagcttcccccaatggcaatgtcttacataactatagtacatgtcaaatccagaacattaccattagtattatacaatactgtaaacttaggtacagaccttatttggatttccccagtttgtttttacacgctcttttaaaaaaaatatttatttatatttcagaagcgtatagtactgtgaacgtttatcccacaggtagatgcaagtaaccatcaccataatcaggatacagaactgacccatcaccataaaaagactgcctcatgatatcccctaactatgtctttcattgtgccaaaagtaaacttttttttttttttttttttgatggagactcactgttgtcagcctgggctggagggcagtggcatgatctcggatcactgcaacttccaccttccaggttccagcaattctcctgcctcaacctcctgagtagctgagattacaggtgcccaccaccacacctggctaatttttgtattttttagtagagatggggtttcaccatgttggccaggctggtctcaaactcctggcctcaggtgatccatctgcctcagcctgccaaagtgctgggactacaggcatgagccaccgtgcccggccaagtaagctattttttaaaaacagcttgatttgaggtataattcacatatcatagccttcactcatttaaagtgtgcaattcaatggtttttagtatgttgataagagttttgcaaccatcagcataatcaattttagagtattttcattatccatggaagaatctccacaaccattagcagtcattcccagtttctctcccctccctcttctctcctgttcaccctctgaccccaggcagtcacttacctagaagtctggatgattttgtaaaaaactgctctatagttgttcactatacctgtgatggagagaagagctggagcagtatctggagaaggacttgtgtcaaagacagtccttttgtcatggtttaacctgggagtgacttgaatataatcaaatgctgtagaaaatgaggatacaaaaaacaataggattatttggtcaggtaatgatgttgaagacgctagttcaaaagcttaagcatagaaattggcctgaggcaggaatgggactgcctcttccattgtaacagaaagaaaagagaaaaaaatcagatagcaatgcagttcagtgtatagagttgataggagaaaactgagggagttatctaatgatttttaagtcctttgtgaaacaggaggtcaaatcatgtgctgagagtaaaaactacgtggacttagaaaacggagagcatgtggaaaagctacccggtagaattggagagacagctgaaagagagccaaaaagatgagtggggtttacatatggactagttgagattggagtccataaatgttcatttggaggtattgaaatgctggggtctgacacggcaacctaagtacagacaaggagaaaacagagggctggagtggtccagggctgaggtgcagctctgcgggggccatgcaaggaggatacagggacaagtgagatggagtttggcaaaggaatggcttaagtaatggcaagtggattggaaatgaagggaagaaagtaaggggctatcatggggccagtgggaagatttaagcttaaggttttggaggtggagtgtatcggccatccttttctcccagcttacttctcttaccttacctctaactccacccgcagttacaacaaacagtagcatacaagcttcagcctgctttgctcaggccctttcccaagtgcttgctcactccctcgtgcctgcttcctgcagtcttgatttctaggagaactggaatcccctgtggacctctccaactcattctccttagtaacctgaccaaaatcaagggcagaaggatgagggggtggatggtgagaggaataaatcaggcatgcaggggcttgggctatcgcatatccccacagacagtggaggagcaggcaggtgtgggtgattctgggctgtgtgtgcaaagattctggtgaccttttatcaggccagaggccctcacagtgcaaagagaggaagcaggggttaggagcctcagctggaggcttcttaataataagttttcttgtttaacaacagaaggatgttcatactgttaagctctttactttacttaagcaggttattaaatggtattaatgaatgtttccaattttgttttaagtgtgtgtatatgcaggcatggaaattaagctgaattgcatcttcaactataccagatgttacaaaattcttcttcaaagcagctgtaccacatttacccctctaaagcaggatgtaagtgtttccatgctccatatctccaccgaggtttgctataattagacttaaattgggtgagaaaagtcagtttcctgactgaggttgggcatcttttcatatatgctcattggcagtgtcagttttacctgctctgaactgcccgtttgtattctttgatcacttttcactgggttgtttgcctttttcacattttatttatttggctttaaaaattttttatatcacaagatatcatcaactttttctcattttttaaaatagaagtcctcatatactatagtctgggtcctagtctttttttttttttttttttgagatggagtcttgctctgttgcccaggctggagtgcagtggcacgatctcggctcactgcaagctccgcctcccaggttcacgccattctcctgcctcagcctcccaagtagctgggactacaggcgcctgccaccacacccagctaatattttgtatttttagtagagatggggtttcactgtgttagccaggatggtcttgatctcctgacctcatgatctgtccaccttggcatcccaaaagtactgggactacaagcgtgagccaccatgcccagccctagtcctttgataatcatatgccaaaaaaaaaaaaaaaaaaaaggaagaagaagaaaaaaaaaaaagaaagaaattttacaaaaaattacataattaaaagggatataatcagtaccttgcagtaattttcaagtgttctacaaggaacttgtattaattttcagaaagacatgctatattaaaactctttagccatgtctgatcccacagatgattgctgtggagggctaccccttagatggccttcgaccccaggttttatgagaactgcaagggcgtcttctagagttctggccctgtggtgactgggatggtgagtgtcttagtctgctatttttgctgctataacagcataccacagactgggtaatttatgataaacaaaaatgtattgggcccatggttctggaggccaggaaatccaagagcatggtgctggcatctgacaagggtcatccatggtggaatggcagaaggtggaggtgaacacacaagatggagagcaaatggggctgagctgatcctgcagaaataaagcccccctgagagaacagcattattccattcatgagggcgaagcctcatgacctcattatctttttttttttttttttttttgagacagggtctccctctgttgtccacgctggagcgcagtggtgcaattacagctcattgcagcctcaacctctctaggctcaggtgaacctcttacctcgactctcgaatagctgggactacaggtgtgtgccaccactccccactaatttgtatgtgttttttttttagagacaggatcttaccatgttgcccaggctgatctcaaactcctgtgctcaagtgatcctcttgcctcagcctcccaaagtcctgggattacaggcgtgagccactgcaccctggcacctatcatctattaaagtttccatcttccaataccagtacatatgataattaaatttcaacatgagttttgatgaggacgtttgaaccaatttttcacacttctcagggttaaattcaggggtgaagggatatgcaatgaatttcagttccagatgtgtacagcaatagagaggcataggaaattgttggcctccctgaggcctcacccaggacaagcaatggagagaggatggctcaggaatcaccattgtcagcagttactcccaagatttgacccaggctcagtgggttttcctgaggctggaacaggagtgagaatgtctcagccatgttccccagctcctcctggctcctgacaatcctggggccagagaattgactattcaagacaaatgggttaatggcccagcgggtcatgacacacaggtaacaacagagagcaacctgtactgcatttccttgaaaagagtcaattaaagaaggtgctgaccctggcagagtgagtggctcagccaaaacatcattctacagctcattttgttctatcttattcatctcagtctgatttaactaattttgccagattctagtactcatctaaatttttcttaaggggttataactgtgacagaaaaaataagtaaaaatatataagaagaaaatgggagctacaggttttatctttgcctcctctctcttctctgtgtagacataagcacaaacacactaataatattttcactgccaaagtatctctgtattaattactcaccttgaaaattaccaactgtctgtagaactgggctgagccaggattgtaaaataggcaacatctatttaatatctcatattgttgcagtactttggaattttgagtgggctttcaaataagttaaaataatagaaataaccttccaggaaagatcaagcagattttatgtcccccattagacatataagaaaagagactgacttgcccaagacgtcctatctaataaatgatggagctgagactggaaccaaaacattcagattccgagtccagggcatttctttccatcatttattgggtcagatgatgatttctaaagcattttacaccctgaaacttcaggattccatgatttattttgtcatttccaacagtcaggcattcatgctctcacttgccatctggctgcacaaagactgcccttcactgccacctacgcccaccctgattttaacactgcccagcacctatgcacttcccccaaagcacccatccccagtcccagtggaaaatatacttattcggtgttttatgttcagagaccttctccacctgtgctgtccaatagaaacaaaatgtgagccgcacatttaatttaaacttttttgtcagccacattgaaagaagtgagattaattttaatgctacattttgtttagcccaatatactcaaaatattatttcaaaatcaatataaaagttgggatattttataatcttttttgtactaaatgtgtgtattttaggcttacagcacattgcagttctaactagctacatttcaagtactcaatagccactagtggccaccatatttgactgaagagtttttttttctatttttatttatttttaatcttttaccacatctttttaaatttattttttatttcaatagtttttagggaacaggtggtatttggttacatggataagctctttagtggtgatttctaagattttgccatacccatcacctgagcagtgtatattgtacccaatgtgtagtcttttattcctcacccccgtctcacccttctccccaagtccccagagtctattgtatgattcttaaggcgttgcatcctcatagcttaactcccgcttgtaagtgagaacctacaaggtttggttttccactcctgagttacttcacttagaataatggtctccgatgccatccaggttgctgcaaatgccattattttgttcccttttatggctgagtagtattccatggtgtgcatgtgtgtatgtatatatatatataaatctatctatatatatatatgtatatatatacatcacatttgctttatccactcattggttgatgagcatttaggctggttccatatttttgcaattgcagattgtgctgctataaacatggatgtacaagtgtctttttcatataaagacttctttccctctgggtagatacccagtagtgggattgctggatcaaatggtagttctacttttagttctttaaggagtctccatactgttttccatagtggttgtattagtttacattcccaccagcagtgtaaaagtgttcccttttcaccatatccctgccaacatctataatttttaaaatttttttaattatggccattcttgcaggagtaaggtggtatcacattgtggttttgatttgcattcccctgatcattagtgatgttgagcattttttcatatgtttgttggccatttgtatatcttcttatgagaattgtctattcatgtccttaacccactttttgatgggattacttcttttttccttgctgatttgtttgagttccttgtagatcctagatattagtcctttgttggatgcatagtttgtggagattttctcccactctgtgggttgtctgctctgctatttcttttgctgtgcagaagctttttagtttcattaagtctcatctatttatctttgtttttgttgcatttacttttgggttcctggtcatgaactctttgcctaagccaatgcctggaagagtttttccgatgttgtcttgttttggtcctctttagaaggtggtttcataatcagctataaaactccaacaggtgctcttaaatgcaggtttctgataactgtggagattgtgacatcagaatagaagaaaacttttaggactcacggagtactgaaatgttcatgaatatcaagcagaacaggaattaactgcatggactaaactaatagaagtctgaaataatctttttaaattttgcttaaaatgttgctgatcctttgttttgtttttcagagtcaataacacttttaagttatttacagcttttaacagttgagtaaagtatactcctatgaaaaaaatttggagcatattcatttctaactgatttctccagaagttggaaattatttgtgggtatttttaacttatgacaatatgttatttgcataagtgcaataataatctgttttctgtaacaggacacagttggagaaactggtattttaccaaggctttgacagggatggcatgctttcctttaaggaatcaaacttgacttatggagtcactaaaagccccttggaaaaactgacctcatacctttgtctacaccgtccctgtatagggttcctgacctgtggcaagtaaagaatgtcaccttctgacaggcccaggagccccaggtttatcttgggacctcaagagaagaggaatttactcaactcacaggcatttgatggtacaaatccatggctggacttggcttttaaaaagtcttatctgagattccttctatggaacaaagttccatcaaagccaatttataagcctatgtaaatatttttgctgcactgtatacaaataattaggccaagtataagaaagcaaaccaatcttaccatgatttgtctttagtaaaaatgggaaactggagagaaaaattatgtttcaaaaactatagtacacctgttgttagattctagtcttccctaatgtttttcaatttttattattttctacagtttggattgaattctaatttttcttggctacaagtcttcatcttcaaaataatgttttcatttttttctcttctttttttccccatttttcctaatttggagtcactgaaaactaaactgtgctttcctgtgaactgaagccagacaacttaaacttcagaggaaaataacagcaacctatgtacatacatgatgtacatatgtacatcctatgtacaacctatgtgcatacaaccactttcataactgcctactgatgtatggacttcagagttatgtggcctatatcgatttgccaggattgttcttttgcctgttattgtttttctcgcttcctccccttattttctcttcaaaggacatgagacttcacaaccttgtaaaaatgagctttcctaataactcaggacctacccatctaggaataaaccatcccaaccaggagagatcagatgaaacctgagaccacagactcattttcttctaaaatgctttctccaaaagatttttaataagaaaagcagggaaatatgaaaggaaaatttcttgggcccccaaaatcactaagctaaagagaaaagtcaagctgggaactgcttagggcaaacctgcctcccattctattcaaagttacccctctgctcactgagataaatgcatatctgattgcctcctttggagaagctaatcagaaactcaaaagaatgcaaccatttctctcttatctacatatgacctggaagccccctccccattttgagttgtcccacctttgcttcgagttctcccgcctttccagaccaaaccaatgttcatcttacatatgttgattgatgtctcatgtctccttaaaatgtataaaaccaaactgtgctctgaccaccctgggcacatgtcatcaggacctcctgaggctgtatgacgggcacatgtcctcaaccttggccaaataaactttctaaattaactgaaacctgtctcagattttcagggttcacataatcaaccttctgaattctttatctggcaattcagagatttctttttggtttcgatccattgctggagagctaatgtgatcttttggggttgctatagaaacttgttttgtcatattaccagaattacttttctggctccttctcatttgggtagactatttcagtggaaagatctagaactcaagggctgctgttcagattattttgtcccatggggtgatcccttgatgtggtgttctccccttcccctaaggatgggcttcctgagagctgaactgcagtgattgttatttcccttctgggactagccatccatccgggctaccaggctctgggatggtggtagggaatgtctgcaaagagcctgggatatgatctgtcttcaggtctcccagccaaggataccagcacctgcttggaccagagagttttaaatagtgactgtaatgtgagcttttgatgtcctaaggaaaagatgtggcctaacatagtttttttttttttcctgtctatggagggaatattttggactatgtgaaactgtgctataccaggtcatatcagctccaagctcccttgaagcatttgtcttaagtctcagttcaaacctggctctgcccgtaactggttgtttgaccctgagcaactgacttaacacctctgggcctctatttcctcacctaccaaaccagaatactatgacatattttcagtacttttgtgtgagttaaatttaatattctgtatagggacctatcactgtgcctgtcctatatatccacacttcaacaacagcaactcttgattgccctctcctccctctatgctgttcagtcatgctccaccttctatgactagatcagcctggtatgtagccaccacttgaggaggagaaaaggaattgacctcctcagtcacccctggacatccatgcaccagtatacctgtgaccacctgtgctgggttgaatagagtcatcctgaaattcatatccaccagaaaactgaatgaatgtggccttatttggaaacagggtctttgcagatgtaatcaagatgaggtccaaccagattagggtggggcctacatccaacgattagcatccttaaagggaggccaagtgaagacacaggggaatacataacgaaggctgtgtggtgttggaggcagagattggagagatgtgtttaccacccaaggagtgccaaggattgctggcaacaccagaaggtaggaagagctgaggggtgattcttccctagagctttcaggagtatggcctttctggcaccttgatttttaatttctaacctccaaaactgaaagataatacatttccattgttttaacccatccagttttcagcaatgtgtgatgacagtcctaggaaatgaatacagcatcatacttttttctaggtggctttgccaatagattgtcaattcatgttctgtcatattcagttttatgtcccctgttcttagcatagcacttggcctacccgggtgctcttaaatgactgtgggctgaaaatgaagcgagaaaacacatggggaaaaccaagttggataaacatggaagggtgtcagtttaaccctgatacagctcgaagaatggcttacatgggccaggggaaggggcaagtttggaacattctgtgggtgattgtgccagaaagtgatccaagaatctctgattggagagtttgaatgtaagacacagagaaggacatgtgcagtaaaggagcccaaagcagaaagacctctgagaggggacagtaagcagaagccttaaggcaggagaagccatgagtgcacacccacaggagaccagagagtactcagaaagtcacttggctgttagaagtggtcattatcaatacagaatggagacttcccgagtctcaggaaaggccaccaagagctgcccctaggccactaggaggtctcctggagaacattctaggtcctcatgccacctactcaccctctgctgaggtggcttccaatgctttctcactcacttcccttatgaatctttacagctaatcaccatcctctgaggtaacctgagtatttttctcaactgcaggcctaaatgtagtttgatttaatttgactgcttctagatagttttatttttactttatagaaaaggaaactgcgattcgtattagcccattggtgcgtttaagcgctctctctctttctctctctctctctctctctctctctctttctcttcctttgtctctcactatttttccctcttaggttagttagagagtgggcatgtgacacagagaagacagcagcaggaaaggtacattttgatgggacaaggaaggtgttgtgtgagaaatcactgggtgctcacgggttctgccgagacctgcttggtcgtggagaccctaacccagtggcgctagacaaactaaagacacacacacagaaatatagtgtgtggagtgggaaaccagggggctgacagccttcagagctgagagccacgaacagagttttacccatatgcttattgagaacaagccagtaataagcattatttctatagattataggttaactaaaacgggaaacaaagggatgggctctggctagttatctgcagcaggaacatgtccttaaggcacagatcgctcatgctattgtttgtggttcaggaatgtgttaagcggttttccaccctgggtgggccaggtgttcctttccctcattccggtaaaccaacaaccttcagcgtgggcgtcatagccatcacgagcatctcacagagctgcagagattttgtttatggccagttttggggcctgtttatggccagatttgggggcctgttccccacctgtccccctttttgtttttgcaagacgataaaagcaaaggtggctttgtcacggtgagctacttctcacaggagctgggatctgcatctgcagactatacaaagacaagcaacacagactaataacacaatcatcattgaaatcacagagcatccaagtgtttttatccattttaatgggttgatagctgctaatccatctgcagctccttcaagcactccagttcctggcattaaggtcaggtgtgcctgggatactttaaatatttgttcttttaattttggaatatctgacgacaagtttgtagagtgtccttctagatgcttttttattctttcccaaattttgatcttattaagagccattaatagtttccacaaatcctgatgtttagctcctagaatgggccatatcatttgagtttgaggtgccactgtaccaccatgtttccagataataggaactcttgccatacttcttaccatttctaccatctgaccattttgttcagaccagctgaacatagtatggccatggcatgcagactgagaggtgcaattcaaactaaacatcctcttagggaaccaatcagtaatgattccatgggaatcgttgtgcagcctccctgcctgttctgcaatgcaatctttccaaacaagtacgttcatttcttctgaccaggtccaatcctgtttacaaataggtttttgagggtggtattcctcaagtatagaagcagatttgttatggcaaatactgagaccagaaagcatgtgtaagtgtgtcatagagtgattacatccggtcattattgccagtcaagatttgatagcgagggggtaggcaactagtggcctttcccaaacagataggtggatgttcaaatcctaaagaaatattcataacagttccttcctcatgtgggtgagatgggcctctatcatctgtaggaccgagcatccaagagttatcattagtgtatacctccattggggggtccagccaagttacaggctgtagaagtggtggaaaaggtaaatatgcccaataagtataatcgttctctgtgtcagcccttgctaaaggaatactcatggcaatggtgatcaccgctaccatggctatcattaaattactcattgtgactggttgtcctgctttcctcaggttttcttctgccatctgtgacagcttcttgatctgtccccaggtaggtggctgtgttcaacgggtgttggtcgtgacagttggggtcctccttagcatcaacttggacaatgctgccactgataggtctttgggatccccccaaaacctcttcctgtgtatctggctcatagtgatgctttagaggtctcgatggtacccaaataggctgttgattcagtcctggagaaacacaagcataacctctaccccaagttattatttgacctatttcccaactttttgttatcggatctctccactaaaccagttgttctgcttgtctttgcagctggtttctgtaaatgctgttcagccactgttgtaactgctgaacagatgctgttcagatgctgttcatctggtctttaggcacactcaaaaaatttaaactcaataatgctagattcaattgcatgtgtggtgtcctgtagtctctgtttccacccttttgcttttgcaactgctgtttcagggagagattgattctttccactatggcttgtccttgagaattatatgggataccaataatgtggttaatattccatatagagaaaaatgtagctagagtttggctagtatagcctggggcattgtctgttttaatagaagctggaatgcccaacagtgcaaaacactgcaaaaggtgatgtttaacacaggcagaagactctcctgattggcatgtatcccagacaaagtgagaaaaggtgtccacacatacatgtacataagctagtctcccaaacaagggaacatgggtaacatccatttgccaaagagaattaggttccaatcctcaaggattaactcctcctgtaaaagatgagaaatgcaccatttggcaagttgggcatcactggataatagctttagcttctttccaggtaatgctgtatctgcgtttgagaccagaggcattaacatgggttaaattgtgaaagtgtctggcattagatattgcagtagcaactaggtgatcagccatttgattacctgcagtcaaaggtcttggaagaggtgtatgagccctaatgtgagtgatgtaaaaagggtgcattctactcctgactgctgtttgcaattgggtaaataaagtcatcagttgttcatctgtatgaaatcgtaactgagcattttcagttaattgtgtggaatgaaccacatatgaagaatcagaaatcatattaataggcatatgaaaagcaatcaatacctcagttagagctacaagctctgccttttgagctgaagtataggatgtctgtaaaactttacctttagagccagaataagaagttttaccattactagacccatctgtgaagatattttcagcaccttcaattggtttaaatttagttattttagggagaatccaattggttaatttcaaaaacggaaacagttttgtttcaggaaaatgattatcaagaatacccacaaagtcagctaaatgggtttgccaagtaagactatttataaaagcttgctgtatttgcaccttcgtgagagggacaataatttttccaggatcatatccatgtaatttaacaatccgagttctcccatttcttttcatagtagcaatttgatccaaataaggagttagagtctgtgaattagtatatggaagagaaagccactgtagaagatcttcctcttgaacaataactccagtaggtgaatgctgagttgaaaaaattagcaaatctggagtcttttcttgatctattctatttatttgagccttatgcactcgcttctcaattagctgtaactctccctcagcctcctttgttaattgccaagggctagtgagactagaatctcctctaaggttagaaaatagattattcatggcctaggtaggaatgcctagagcaggtcacatcaagttaatgtctcctagtaatttttgaaagtcatttaatgttttcaattgatctctacatatgtttactttctgtgacactattgtagtgtcatttactaaggtctctaagtaggagtaaggagtagtagtctgaattttatcaggagctatagttaaaccagcgtgagaaatcgaattttgcaagtgatcataacattggagtaatatttctcaagtgggggcaacacaaagtatatcatccatataattaataatgcaatactattaaaattttttacaagtaggttcaatttcttaccctacataagtctggcaaatttttggactgtttaacattctttgtggcaacactttccaatgaaaacacttagcaggctgcaggttgtttactgcaggaattgtaaatgcaaaccgttcacagtcttgctcatctaaggggatagtaaagaaatagtcttttaaatctatgactattgaaggccaatttttcggaatcatagcaggagaaggcaatcctggctgtaatgcccccataggttgtataactgaattaatggctctaagatctgtcaacattctccatttacctgattttttcttaataataaagaccagagaattccaggggaaaaatgttggagctatgtgtcctttttctaattgttcagtaactaagtcctctaaagcctccagtttctctttacttagtggccactgttctatctaaattggcttatctgttaaccattttaaaggtataggttctggaagctgaacaatggccgccatcaaaaatgatatcctaaaccttggcagaaactttgtctttccacttgaagcagttctttcaaaccttgcaaattttttcctagtcccataccagggacataccccatttcatgcatcatatattgactttgagggctatgtaattgctttggaattagaacttgtgatccccattattgtaataaatctcttccccataaatttataggtacagaagttacaattggttgaatagtcccaggttgtccatcaggcccttcacaatgcaaaatataactactttgatatacttcaggggcattaccaactccaactatgataattgagcaggttgaattggccacgcggacggccagtgctgtagagaaataattgaaatgtccgctcctgtatctaccaaacctttaaatttctttccctgaatagttatttcacaggtgggatgtctatcagtaatttgattcacccaataagctgctttgccttgtttacttgtgcttccaaatcctcctgtttgtttagtttcactttttctccatttccacatatggcacaatcaggagctgtgctgtacactctcctggctctgctttccagggaacagaagtagatacaacaatttgaacttccccattgtaatctgaatcaatgactcttgtatgtacttgcacttcttttaaatttaaactagatctacctacaagtaatcctaccgtccccactggcaagggtccacagactcctgttggcactttttgtggggatctccaggcagaaggctcacagcttctgtgcagcataaatctactgtggcactactggctgtggcaggggacaggcattgttcaggagtgaaggaatggcctgagccagaaatgccccggtttggaacagggctcaggacgggcccctcatggcgtttcctgaaattgggtttccatcgttatcaaatttagaatgacactgattggcccagtgttttccttttttgcattttggacatattccaggctcggcagttttcttttttccctcaactggctgcatgacttgctgattttttctacgttcttttttagtatgaccatgcttcccacagttaaaacaagctccaggagatggagtatttcctttacccattttcagtcctgccatggcttgtgccaacaaagtagctttatgcagattacctccgataccatcacaggccttgatataatcaactaaatacactttccctctaataggtcacacagcagcctggcactcaggattggcattgtcgaaagctagtaactgcaacactatatcctaagcagccgaatctgcaatcatctttttaagagactcctgtaaccaagctataaaatctgcatacagaaacaacaggtgctggagaggatgtggagaaataggaatgcttttacagtgttggtgggagtgtaaactagttcaaccattgtggaagacagtgtggcgattcctcaaggatctagaactagaaataccatttgacccagcgatcccattactgggtatgtacccaaaggattataaatcatgctactttaaagacacatgcacacatatgtttattgcggcattattcacaatagcaaagacttggaaccaacccaaatgtccatcaatgatagactggattaagaaaatgtggcacgtatacaccatggaatactatgcagccataaaaaaagatgagttcatgtcctttgtagtgatatggatgaagctggaaaccatcattctgagcaaactgtcacaaggacagaaagccaaacaccgcatgttctcactcataggtgggaactgacaatgagaacacttggacacagggtgggaaacatcacacaccggggcctgtcatgggatgtggggatgggggagggattgcattaggagaaatatctaatgtaaatgacgagttaatgggtgcagcaaaccaacatggcacatgtatacatatgtaacaaacctgcatgttgtacacatgtaccctagaacttaaagtataattttaaaaaaatctgcatacagttcttttggttcctgttttacagcactaaaggaagggtattgttctcctcctgaagtgattttttcccaagctctgatgcacactcctctaagctattctatggcatcatcctgcatgaccacttgtgcatctaaaccagcccagccgctgacccccaaaagatggtctgcagttatattaatttgaggttgggcctgggtgttgcaagcagcctgaatggaagcttcatctgcccaccaagttttaaattgtaagaactgagcaggagttagataagcttgagtaagagcatcccagtcagtaggaatcatccaactggagacagcaacattctttaacagtcccattacaaaaggagaacttggtccatactgatttatagcttgtttaaattctttgagtaatttaaaaggaaaaggctcaaatgtagctataatatttccctgttgatctggggggggtgtattctaacagggaactgccaagcctctatattaccctctcatctagcttgctgaattcctgcctaaatacaactgagagtggtagctcaagatgctgctcgaacagtcactggggcaactactttttgcccagtgtcctctggaaaagaaagatctggagggtcaggccaatctttttcttcaaaataatgaaggggtgcagaaaggtagggacaaacctctcccttctttgccgctttagctttagctggcaaacaaacctgctctgttacctcttctgttacttcattatactctccttcctcctcatcatcagtgtgaaaaggttccaaggtggaaccaaccagagcccacacttgtcccattgttaccttgatgcttctgagctccccttcttactcaccatggggattgtttaagagtacttgggtgtcctccagcatagttccatgttctccaaccatcgctctggtgacccttcgacccgggttcgagccacacatatgggtgccacttgctgagaccagctcggttgtggagacccaaacccagcggtgctagaggaattaaagacacatacacacagaaatataaagtgtagagtgggaaatcagggggctaacagacttcagagctgagagccacgaacagagttttacccacatatttattgacagcaagccagtgataagcagtgtttctatagattatagattaactaaaacgggaaacaaagggatgggcttggctagttatctgcagcaggaacatgtccttaaggcacagatcactcattctattgtttgtggttcaggaatgccttaagcagttttctgccctgggtcggccagctgttccttgccctcattctggtaaaccaacaaccttcagcatgggcatcatagccatcatgagcatgtcacagtgctgcagagattttgtttatggccagttttggggcctgtttatggccagatttgggggcccgttcccaacaggttcttggttggagacatcagggcaacacgtcaccaacaggaaaaaaacactgaggggagcttcccattggtgcttaggaatgaacaaaaaattatcaactgtaaactgtttccctcagagaaaacagtgtcacaaaaatcttttttaaatgcttgggtgttttctgtattgtgttttcacttagcttagaaaggacaatgcctgccaggctgtaatcaatgttgttacatcaggctctaaggacagttatgaacagtcttctctcctgagatgtttcaaataacacatcctgatgcaactttatcaaataaggcagctgcagactctccaaggccacataatactgtgttttcctaaggattaggttgcataattccagagatatctgtggtttgaagcaaatgaattatcaacagaagagtcatatgtcaatgagcggaatggaaaaacaaggtagaggcagtctttcatctgaggagaaatgcagggtctcccttcaggatgaacagatggttcacccatcttccccaggaaaatgaaaccacagctgtgggtctgagtgccgatgctggatgaaagttggaagctgtctctggaaagcaggcttccccaaggctggatgagtcaggccagggtgctgctcttctggtaaagtcagaattccactaagcaagtaataagcccattggtgtgaagtgtcaacatgtatgtaacaaagaaaagattttacaatcttctaaagcaattatgtccaacctgggcctcatgcagtccaagacagctttgaatgtgacccaacacaaattagtaaactttcttttctatttttttatttttatttattttatttatttatctatgtatgtatttatttatttatttatttattttgagattgggttttgctcttgttgcccaggctggagtgcaatggtgcagtctcagctcactgcaacctccgcctcctgggttcaagcaattctcctgcctcagcctcccgagtagctgggattacaggcatgtgccaccacgcctggcttaattttgtatttttagtagagacggggtttctccatgttggccaggctggtctcaaactcccgacttcaggttatccatccgcctcggcctcccaaagtgctgggattacaggtgcgagccactgtgtctggcctgtaaactttcttaaaacattatgaggttttttttttttttttagcttatcagctatcattagtgttagcatattttatgtgtggcccaagacaattcttcttccagtgtggccagggaaggcaaaagattggacaccactgttctaaagagaagaaaaagaaatatagagagaggattaaaatcaaaatgatttcagtcttctcaagagtaaccctaaaagcccaaagaccaacagagcaatgctttaaaaactccaaaggaaaattatttccaaactagaattctgttccaggacaaattcactaattcatgtgataatagaaagaaagatattttggatctagaaagtctcaaaaaacttatctcccattcacttttctcagaaagctgctagaggatgtgctccattaaaacaaaagagtaagctcagaaaggatgtaaaaaatgaaaggtgcaacataggacagctacaaaggaatatggggaaggggatcccaggatgtttgcagggctttctgacttacctgagacaggagcaggtcagaagtttccaggaaagagttcttcatgaaaaataattgatagactctctgataagaactaccaattaagaggatatttagggttgaattaatgataagtacagacagaactaaggcagcaagcaatggataattattaactccattattattcaagaaagtaaagtaatcttgggtgattacacaactcagctgtaaacagtgtttgcatagtatctgatatgagaccaaaccattttttgtgatgtaattcacagtctctaggaagaaatctctggcatcctgatagaaaaatcttgtacttaaaaacaaacaaataacaactttaatgtgattaagacttacactgagacaccagtcccctacacacccagctgactgtcagcccagagtttagtgatctttaaccaaatattctttcctttttgtattgttgggaaatttaaaatgtctacaaaacatcaaaaagaaagaaaccagagtaccatggacaaaggctcatcatctgcaaagatattttatatgcagagagaaattccaccctacttaggcagccaagaagtaacaatccttttttctttctttcttttcattctcaaaggaggtgagaagttacattccttttctactgccctatttttagccattacatacatatgttctctattaacagtaacctgtcctcctatgagaagaattaacagagccatttgctgtacattctttcacagtttagcctaaattcacctttatcaaaaggaataataatggcatgggcaacatggtcagacctcatatctaaaaacaatttaaaagttaccaaggcgtggtggcacatacttgtgttcccagctacttaggagactgaggtgggtggatcacttgagcccaggaggtggaggctgcagtgagctgtgattgtgctgctgcactccagcctgggtgacagagcaagaccctgtctcaaaaaaaaaaaaaaaaggaataataaaatttatctctgcgacaagcagatgaagatagagacagaaaggtgctcagaggttaaacttccacagtgaatggaacatagagacattattttcctaggtgtttatttacatttcaaaaagatggctctcagatttctgaaaaaaacaatctgggttgtaaagtgacaaaaggctaactcaggaagatataaaaataaaattttatatacttttcactgggtgggaccatcccgcccagtgcaaactgcaaaatacttagcagtctttgcccagccccttcccaatataccagtaatgtctaaccccaaccccctaccccgggcattgtagcaataacaaaagaaagagaatgaggagaagggagggagggaagaaaactgccctcacatattttcaaatacctcctggaaaaggaaggccaagctagaatgaccaactcatcccaatttgcctgggacttttcaagtttaattttaccagttttggcactaaaagcctcatgtcccagaaaatccactagttccaggcaaaccaggacagttggtcaactgaacaccccatgacatatgcacacatgcacatgtgtgtgccaaccatctaattatgtatgtgtgccacttaggaaaaaattaaaacttaaaataaaaagataggctttaacattgaagacatctgggtttgtattatggtcctgtccctcaccagttttgtgacctagggcaagtttctgttgatgaattacaatcatccctcggtatcctgagggactgggtccaggagctaccccccatacccaaatccacggatgctcaagtccctgatacaagatgatgtagggtttgcatataacctatgcacaacttcatgtatactttaaatcatctctggatgacttataatacctaatacaatgtaaatgatatgttaatagttgtactgtttagggaataatgacaagaaaaaaaagtctgtgctttttcagtacacataagtttttttttctttttaagacaaggtttcactgtgttgcctaggctagagtgttgtggtgcatagctcactgtggcttcaaactcccgggctctagctatcttcctgcctcagcctcccaagatgcaatttttttcccgaatattttccattcacattcaatccaccaatgcagaaaccatggctatggagggccaactatactatcaacaactctggttgccacttctcttgtctgttctagggaattaaaatgatgtaacctgtcagggctggtgtgagagcaatccctaataaatggccttgcctctttcttgcgtgaatttgggcctcagttctccaaaattcacctattgacacaccctcgatattttttatttcttttttctgagacagagtcttgctctgtagcccaggctggagtgcagtggcaccatctcggctcactgcaagctctgcctcccgggttcacgccattctcctgcctcagcctcccgagtagctgggactacaggcgcccaccaccacgcccggctaattttttgtatttttagtagagatggggtttcaccgttttagccaggatagtctcgatctccttacctcctgatccacccgcctcggcctcccaaagtgctgggattacaggcgtaagccaccgcgcccggctgatattttttatttcttctttagcgaaattagcttattgtgttcttaactaattttctgtatctgaattagaaaaggagctgatatggtttggctgtgtccctgcccaagtctcatcttgaattgtagttcccataatccccacattcccattacctccatgctgctgttctatgatagtgagtgagttctcacaagatctgatggtttcataaggggcttttccctctttgcttggcacttctccttcctgccatcatatgaagaggatgtgtttgcttccccttctgccatgattgtaagtttcctgaggcctccccagccatgcggaactgcgagtcaattaaacctcttcctttacaaattaccaagtctcaggcagttctttatagcactgtgataatggactaatacaggagcctttgtgaacaaggacaatgtctttgcatcctggttttatagttcttaatgcagtggctgcagatagaggattcagtaggatttgttagttgctatatcatctttctcaatctgtaaagtgctgatattgtacagataatagaatgggacatgaataacttttatagaatataaatcttcaaattcagtaatttactagtacggtgcacagccaatgtgcttgggggcagctccggctgatgaattacctcccatggcctggctctcttggtgacttaagtgcccccaaactagggaatagtttagctgagttagagacaatttgggcaggaaaattagggagtttgggtgtaggagaaggttcagttgtccaggaaaggaaaggagacaataactttcatgacagagagacaattctagggttaagatgatgccagaaagttagcaagtgactttcctaaagccatttcatacagtatatggggctggctgccatcttaccctttttctcatcaaaatttttcaattaaaatgtgaaacactgacttttatcaaagaagttaatgttagggttgccagataaaatataggaagcccagataattttgaattttaaataaacagttaataatttgttagtgtaaatgtgttctaaatattgtgtgggacttatactaaaaaattatttgtcatttctctggaattcaaatttaacctgggcttcctacattttgtttgctaaatctggcaacgccagtcagtgaaaaataaaattcacttcacagaaaacccacagcatggctaatgtccatgagaatacctttaaagaaacacggcccttgatccacacagacatacactacatattataaatgcaggtcaaaattcttcctttaatgtgattcatgttattttaatgacttttaggtcaaactcagattcccagttacaggtgcccttggctagttttatctgtgtaacatttgaggctgcatatgtgatcatggtcttgggtttcatctgagatgttagaagccatgtctcttgaggtacttggctcgtgcaaggacatcattgcagaagtcacagctcaggtcctggctgcttcggacatagccagcacccccactgtaggcacagagtccacctgaaatgcatgagataggttaatgctgacctagggtactcagcagttaactctgattctctttactaactacctaacaggaggcagctggagtttcggggaatctggtgcaatgtattatatttgtccctattaattctgtgcttgagacaactgactgatagcgttacacgtacctctcaggtactggtcaggggtccaggttggaaacctcctctggatttctttgattctagtagtcagaacttcagttgtctgggaaacctgagactcactaatccaggatgtgggagcttgagagccagggtcctgcagggaaggaggcagagaagaagccacgtaagctgggtgggagggtgatccggcttactgggctcaatggcgcttgttcatttcctgtctcttgttctcctttcacctttgatggaaccaatgccaccgtcagtctcctgtgaggtaggttagatagggtggtcatagcctcccttatggggaacaaatttgccagacaggtggagagaacaaaccactgacagtgcacaaactacatggtcagaatatcctacagtgccagacacggtggcttatgcctgtgatcccagcactttgggaggccaaggtaggtggatcacttaagctcaggagttcgagacgagcctcagcaacatgggaaaacttcatctcaacaaaaaatacaaaaattagctgggcgtggtggtgtgtgcctgtaatcccagctacttgggaggctgaggtgggaggatcacctgagcctaagaggatcaattgagcctgggaggcagaggttgcagtgagccatgattgcaccactgcattccatcctgggtgacagagtgagaccctgtcttaaaaaaaaaaaaaaaatatttgcagtaaggagacaaagaacagaagggaaaattcccaaatccatgcaagcacagaaacccatgattagtgtccttgggctgacctatgctcattgtaagagtgaaaaaaaagcacactcctgggtggagaattaaaatgctgagacacgcgatgtatgtgctagcatgcacaacaatagcgcatgtgcatcccggagaccctgaaacatgcttaacagcaataaccatcccctctgtcttatgaataatcatataagctttccatgaagggattttcccaatgtcacatgaggctgtctcattctccacccagctaccagagtgtagttttgctttgcaataaacttcttcgcctacttttaatttggactcgtgcccaaattcttctgtgcggcaaagtcaagaacttgaactggccctccaacaacacctggagatcagacagtaaagccatttatacctgttagaatagctactgtcaaaaatgcaaaagacaggtgctataatttgaatgcttgtcccttgtgaaattcatgttgaaacttaatccccgatgtggcagtattgagaggtggggcttttaagaggtgattagattaatctatgaatagattaatagattagtgggttaatggttatcacaggagtgaggctggtggctttataagaagaggaagagagactaagccagcacactcagcctctcaccatgtgaggccctgagccaccctgggactctgcaaagagtccccaccagcaagaaggctctaccagatgtgtccccttgaccttggggtccccagcctccagaactgtaagtaataaattttatttttcataaattacccatatttaggtattctgtaataagtaacagaaaacagactaagacaactagggttggtgaggatgtagagaaactgaaatcattgtacattgttgatggcaatgcaaaatggtgcagctaccatggaaaactgtactgtggtttctcaaaaaattaaaattagaactaccatatggtctgggtgcagtggctcacacctgtaatcccagcactatgggaggccaaggcaggtgggctcaccaggcaggagtttgagacctgcctggccaaaatggtgaaaccccatctctactaaaaatacaaaaattagccaggtgtggtggtgggcgcctgtaatcccagctactcgggaggctgggacaggagaattgcttgaacccaggaggtggaggttgcagtgagctgagataatgccattatacttcagcctgggcaacaagagtgagactgtctcaaaaaataaaacaaattaaagtaaaaattaataccatatgatttagtaatcccctttctgggtattcatccaaaagaattggaatcaggatctcaaagagatatctgagctcccacattcattgcaaagctattcccaatagccaagaggtagaaacaacctaaatgtacctgacagatgaatgaataaagaaaatgtggtatacacatatcatggaagattattcaaccttaaaaagaaggaaatcctgcattatatgacaacatagatgaatcttgaggacattatgtaagtgaaataagccagtcacaggacaaatactgcatgatttcacttatatgaggtatctaaaatagttaagttcatagaagcaaagaatagaatgatggttgccaggggctgatggggagagggaaactgggagttgctaattaatgggtataaaattttagtcatgcaagacaagtaagttctagagatctgatgtatgacattgtgcctataattaacaacactgtattgtatgtttacacatctgtagccagcattatccttagcaaactaacacagaaacagaaaaccaaataccacatgttctcacttgtaagtgggagctagatgatgagaacacatggacacatacaggggaacaacacgcactggggcctattggagggtggagtgtgggaggagggagaggatcaggaaaaataactaaagggtacaggcttaatacctgggtgatgaaataatctgtacaacaaacccccatgacacacgtttacctgtggaacaaacctgcacataaacccctgaacttaaaggttggaaaaaaggctttctttttttttaatattaggtttgtgactgtaaatctcccttaaagcatttttaccatatctcatagtttctaatatctagtgtttctctatcatcctgttttagttatttttaagtttcactatgatttgtttctttaacctaagagttacttagtgttgtgtatgtgtgtgtgtgtgcatgtattttaaatttccatatgatcagagatatttttaatttttaaaattatcttctagcataattgtattattgtgatatctgaaatttttgaggatttctttaatagatgatatatgatcaacttttgtaaaatgttcctcatgtgcaggaaacaattgtgtatatcctaatggatacgtaaataattacatccccctcatttttctctcctgctctccctccctccccaattaacaatcaagcctcttaattgtgttcttattacatgtgttaattgttttacttatttttcttctatatctttgctggtttgtttattgtataacctgtaaataatcaagagagatgtgttgaaatttcccattatgatagcaggtttattattatagtaataataatttatgctgcatatattttgaggctattttactggcatctacttgttttaaattgctgtatgtcctggataaattcaatcttttttgttatgtcataattctctccataccaaatattttttcttctaaagtgtattttatttaatatatcatagttatcaacattattttgattattgtattcctgataggtcttctttttaccatacttttacttcaaacttttgcatattcaaatgctttaagtgtttctcacataaaccatgtaaatctggatttgggcttttaatctcgttcatacatctgtgtctttaaaccagtaggtttcctatatttatatttattgccattattaatatcgtgtagttgctactatcatcttaatttgttatttcaatgtgtctctctttttctacattcctttttactcttgtcttaactattattattattaatattgttagaggtagggtcccactctctcgcccagactggagtgcagtggcgtgatttcagctcactgcaacctccgcctcccaggctccagcgattctcctgcctcagcctcctgcgtagctgggattacaggcacctgccactactgcctgactgatttttgtatttttagtaaagacaggatttcaccttgttggccaggctggtttcaaactcctgacctcaaatgatccatccgcctcagcctcccaaagtgctgggattttaaagacgtgagccactgtgcccagcctattttgtaaccgaaactatgtctcaccctaaataaggcaaggactctctgatcctttgtctccccaccactgcttccagcacccatcatattgaccaaacctataccctgggttttacttaaaatgtggtccgggaaccagcaacatcagcaacaactgagaacttatttattagaattgcagaactttgggccccatttcagacctactgaatcagaattctcatgtaaacaagagctccaggtgttcatatgcacaataagcttcgagagtcagtaaactagacttaaaaaacaaaaatctgtggccgggtaaagtggctcacacctgtaatcccagcactttgggaggctgaggcaggcagaccacttgagtccaggagttcgagaccagcctgggcaacatgatgaaaccccatctctacaaaaaatacaaacattagccaggcatggtggtgcatgcttgtagtcccagctacttgggaggctgaggaggatcgtgtgagcccaggaggcagaggttgcagtgagctaagatcataccactatactccagcctgggtgacagagccagaccctgtcttaaaaaaaaaaaaaatctgttaagatgatagatctcatgttaatgttaagtggtgttcttgccaaagaaaaaagatagtcaagttacaaggtttgggctaaggaagggatgagcagacctttcactgctgcttcagcttaagggtgtaactcagttaatgactgagttagtgtaggtagcagtgtgatgccctccttcaatgctgccagtgcaaaccctccaaacagtccagaaagggatttttctgtctgaacttgtaattctttttccagatagtctgaacgtctaaagggacttctaacccttcttatacgcctttgattatcacttccatgtaggtttcatcatatttgggagaaatgtccaaatctagagaattctcttgtttgttgttgttgttgttgttgttgttgttgttttttgagatggagtctcgctctctcgcccaggctggagtgtagtggcatgatctcagctcactgcaacctctaccccccaggttcaagcaatcctctcacctcagcctcccaagtagctggaattacaggcatgcaccaccatggccagctaatttttgaattttagtagagatggggtttcaccatgttggctgggctggtctcgcactcctgacctcatgtaatccaccctcctcgtcctcccaaagtgctgggattataggcatgagccactgcgcctgacccaaatctagggaattcttatttcatcttcaaaggaaatggactcatcctttcctcaaaagccagattttacaaaggagacagaacagcgcagcagaaatgatgccagccctaacatcacaagatattcagtcccagttctgcctcttgcagctgccatgtgactttgtagcagcaactccttccttgtgattctatttcctcacttgtcaaggatggattacgtgtccctcacctcatcttatcagattattggatgggtctccaaatcgaagtaaaataaagtatttgaaagtactttaaaagtatcatacaaaaaagtcaagggaagcaaatttggagagatcattgagaaataaatttttctaaaatcttaaaaaaaagactgcaatactcacaggttcctcaacaacaaccacaaaagcagtgtgagatcaatggaaaaaatcaagcctcattctcacccttgccatcactgattccctggcgcagagttaattcaacagtggattagtgaccattccccagaagtctctatctggcaagtgacaccagacggaattcatgcaaaaataaaactcaatcttcagaactaagaattgtatagaaaaaggtaaaggaaaataaatttaacattttttgagaatccaacagatatcaggtacttttttgcattgtttcatggaatcttcataataatgctgtaagaatggcattttataggtagagaaactaaggcccagtgagattaaatgacttattcaaggccatgtggctacaaagtaactgaggaaagatttaatctgtgatctttctcttggaccacttaggtccagaaatccagaatagggtggcccggatgatattctggaaacacggcattatttactgtgaaaagaaattgtggctcaacatgaaacagaaatgttgctgctcatatctctcaggcagaactgtcactgtcacagctctagagaccttcattcatgctgtgttctgtgaagctttgccatcatccaaaaaacaaagcagtggtgccacatagcagaatggccacatgtgtcaacggatgaagagttacctgcaccatgctagtcctatcgcccatgttgaccagaattttgtcaccgggagacttcctggacaagacaccagcgatcacggcaggatccatgcagtacttttggccaatggtttgcatcatgggttgatatttcaggaggtatggcatgtctatttcagccagcctttcagaagcacgaactcctaaaccaaacgcaaaaggaatgatgcagcttgttgtgacttatgctgcaacaggagctcaaggggagagagaaagaacaatccaaggatctgagtaatggtcgaggactgacaatcccagattttggtcttaaatctttagtagtggccactccctgacctgaggttagggctctcctcctgtgagcttgagtcagcatcccctgagccagggtcccctgtggctgtcagtgcccttcgactgggctctcaggggctgctctggcccacccaggacaattccatggccataggaaccattggtcccattctaagcaccccaataaaatgaaatgtgcctgcctatcagctgcaacctgacatgaaggagaaattctgcaaacccttcaataagtctttagatagtgttcctcaacaagtttgttcacaattgcacagttttccactcctaaacgataccaacaaatcatgcaagtttaaacctttctgaaataataagaatgctgggcaaaaggaaagccaatattaatctacttagctagccttaccttctaggtgcttttatggtttaaaaagcaccctcggccgggcgcagtggctcacacctgtaatcccagcactttgggaggccaaagagggaggatcacctgaggtcaggagttcgagaccagcctgaccaacatggtgaaatcccatctctactaaaaatacaaaattagccaggcatggtggcacatgcctgtaacccagctactctggaggctgaggcaggagaatcgcttaaaccggggaggtggaggttgcagtgacctgagattgcaccattgcactccaacctgggcaacaagacagaaacttatctcaaaaaaaataaataaaaataaaaaataaaaagcacccttgtccacattgtgtcaatcagagctcacaacaacactgtaaataccgtactgctagccgccttgccacggatgcaggggcagctaagtgacttgttcaagaagcagagctttgggaccccatacccggaactctttccaacactcagtagcgtgaggcatgggaaacagtgaaagccgggggataggttgagagggcgaaagctcatagctaccacagtagttcaggccgtgacgtcttccaatcccacaagatgctccaggggtgtccaggctttggatgtttccatagcatccccagttgctgctttcagacaagtctacaagttgagaaaagttcagcctaaggcatggaactagttctcatcattcttctgtccatgaataaaattacattaataaaagtaacaataataaaatccattacatcaccttcactctgcaattgaaactcttgaaatttaaatgagaaatatcccataaatgatcacaaaaacttcctcaataccaaattctcacctgctcccctgcagacatgagtaactactggagctattgaagcagttacactctttgtaaagctctggtgccctttgatgttgtcaggtggtatcttggaacacaaaggagaggatttgttccctgtaaagtagtcctcatcttacttttttttttttttttttttttttgagatggagtctggctctgtcgcctagtctggagtgcagtggcacgatctcgactctctgcaacctctgccttctgggttcaagtgattctcctgcttcagcctcccaagtagctgggattacaggtgcatgccaccacgcccagctaatttttgtatttttagtagagacgaggtttcaccatgttggccaggctggtctcgaactcttgacctcaagtgatccgcccgcctcggcctcccaaagtgctgggatcacaggcgtgagccaccgcgcccagcctcttctttcatcttatatgaactctgagcacttctccgtcaaatactcctaacttgttgctctgatgaaatatttatgtttgctctggagaaacaagtataaaacctggatctctctgggatatcaacccagatccaaagtaaggcactgctcgtaaatgaggatttgaggctggctacactttctctcaggtacacttctagataagagcctaaggctgcagaagggagtgaaggagagaggcatgggaccagtctccacatgggatcacccactttccacttcttccctttatctctttctcctttccatctctctctacctctgtcattctagtcatcactgaaggggaggagtggtttcagacactcgggatttcacaaaggccattgaagaggagaatgttctttctcttcacaccaggaggagagtgcatgagtatttagatctacaattcacacaaggtgggtacacaagtatttataatatatctacaattcacaccagaatggggacacatgagtcagtactaagatacctacagtaggcaggaaattgctccttttgagaatcatctcaccattataaggctgtaagaatgtctcattagattactctttaattaattaattaattaattaatttatctatagacagggtctcactgtcacccaggctggagtgtagtggcatgatcatggctcaccacagcctcaacctcccaggttcaagctatcctgccacctcagcctctcaagtagctgggaccacaggcacaagccaacacacctgtgtaattttttgaagagatggggttttgccttgttgcccaggctggtctcaaactcctgagctcaagcaatttgcccgcctcgacctcccaaagttctgggattacaggcatgagccaccgcatacacctggtttactctgtttaatctatttgatcctttgactaaagtagattagattatcaaaccttaatgatttgcagatctttggagatatatctattgcctataatcatatgtgtcctgtgtgtttacataaatgcattttcaggttctactttcttagaactttatggggttgataaatactcgtcttttggagtaaatacttctactttacaaacttgtgataagtaacctaagaaaaatgtggaaatgaaaagactagatcttttatgaatatactaaaaattaaaccagctgacaggttcttttttattttttaatcagtgcacttttatctttatgactggtgacaaatacccttagtactgcagttggttttatcactccttggttcctgccttgtggacctctccctagccacactctatgatcctcaaaattctttgtattcccaatgcttagcaccttgtaggcatttttaaatatttgttgaatgaatgggtcaataactaaatgaatgactatgagacctcatctaagaaatctattaaatttagagtcaggaaaatttagcttctcctgaggaactttgcttcctccttttatttattaaaaaacaagtaggctgggcgcagtggatcaccctgtaatcccagcactttgggaggccagatcacgaggtcaagagtttgagaccaatctggccaacatggtgaaaccctgtctctactaaaaatacaaaaattagccgggtgtagtgacaggcgcctgtaatcccagctacttgggaggctgaggcaggagaatcgcttgaaaccggaaggcagatattccagtgagctgagattgcaccactgcactccagcctgggtgaaagagcaaaattccatctcaaaaaaaacaaaaacaaaagcaaaccaacaaaaacaagtactttccctttttcctccagctgcaaagctgaagttcaatcacagcaactaaatcagcctcagtgattagcttagtcatgtgtactcggttgccttgattctggttttctatttgaattagtcttattcattagtcttattctggcaaccacctcaattcttctatggaaataaatgctttaggaataaattcaatttggcattttttatagtggacaatgagcagctattgatggtgtatatttaaagtctggcttcaagcagtgctgttttaagcccaccttgcattccagagaaccccaatcttttgtgggacatttggggagaggctgattgttggtggctgttcctaactccaggatttgttggacagtttagggaaaaaataatcttttttgttgcattttcaagtattagaagtgccattgtgttcctgtgcttatccttcccatctccaaagtcatttgtaaaaatcagccacactcacccatcagggcaaggaggcccagcagcagccacaatgcagacatgatgacgatctggctctacggctcctgaaacacttttaaaacaaaaattagcttgagaatacaaaaatatcagtcatcatcataaccacatgtaatatttccacagaagcaggggtgaaaagaacaaatttccccatatctgacctaagaaaatgaattatttgaatcatagtgaaaaaaaagcaaaagtaggacaagtaagtgctccattcatcctttcaattaatctaaaaatgagaagactcttactcagcccacaggaactcaacatacagtcaagttactaactactttatttcaagaaggcaagacactttgaatctcaaccaccaagaaacatactgacctggctccagaccctgaaaagcaaatttctgatgcccatacctcatcccaagagcctttttattatctccattatcaaaaggagaattttgtattggtgacttcttggaatttaggtcccttcttcttcaggtttgaggaaagaccacgctttcctcagtgccctggaatgtacactggttggaagacgtttcccactgctctaaccccagcctggaatcacagaccccctttatcaccttgagccatgttccccattccccctctgtaaaaccccaatgcggcaacaaacctggaccagagcccagggagaatggagctacctccaccagcaaatccccaagaagctggctcatgggcaggggtcccaggattgaactcatgaggtgctcacaagactggagaatgaacacgtggccaacatggagcacccgctcatgtgctctctctctctcttatcccaaccattcccctaatcaccttccatgagtacaaacagccctggttctcctactggctaccaaaccaatacacaaataccaccaaggatagtttgctgttaacctcagggaatggtagagtttctggacctttgcctccaaagcgcctcccaccaagccctgccactccagggtgtatgtcatcattgccccagtcagcagagcctggcagcctagcattttgaattattactgtcattacatgtaggaatgtgcatataaacaaggcacttggtactttcataatgcttctctcatctcttttgttttgaggttaaccttatgggttgtttctttcaaacacccaggaagagatcacatctcaagatggagaggctttaaggaagtcatttgaagccaggtgtggtggcatacacctgtagtcctagctacttgggaggctgaggcaggaggactgcttgagcccagagggtcaagggtgcagtgagctatgatcacaccactgcactccatcctgggaaacagagcaagagcctgtctcaaaaaagaaaaaggaagttattcgatttctgtcttcttaaactgagggggcatatgcccttcagttgcagtcatgctttttgttattctctctacaacattgagatggtctgtccgattttgcttagttgagcacaaaatgtcatggtcagtcccaacaccaaaaagattcagggacctggaatcttagctgggtctgcaggaacgctcagatttaatcacccaacaggagtcatttattcagcatcctgagcctccagcagtaaacaagagaggacaaccaatcccaggagaaaagaatggacaaagagctgcttgggtataggaaaagctcatggtctcatgaaagtgcatcactggctttatggaaggacccttcaggaaaaagcactgctcacattcaaatgctccacccagggtatttcactctttttgctgcttttccaggaaagaaaaaatacttcctcttggaaacccaagtggaaggactcagcttttattgtaacaggagagctaccgtattttccatgcttggaactaaatatctgtgttgagaagtcactttaatgaaagagtctatgtaaatacatgtgccacttaatgggaacacagaattactttctagttgctcctgggaccaggtcatcaaggtaaagtttttcaatttcatcagggaagagcaagaagtgacaatggaatttttcttttttttcttagagccagagttttactctgtcacccaggctggagtgcaatggcacgatcacggctcactgcagccttgacctcctgggctcaagtgatactcccaccttagcctcccaagtagctggggctagaggtgtatgccaccatgcccagataattttttagtttttatgtagaaatgggtctcactatgttgcccaggctggtcttgaactccaggcttcaagtgatccttccacctcagcttcctgagtaggtagggttacaggctcaagccaccacacctagcttggaattcttaaatggatgaacaatgtcattttgtccataaatacagcatattgaagcaacccaaactctatggcccaactttacaagtgacgaaaagtactctgtgtttagaagagattgttgagacatcactcgggtgtgctcaaagagtgtctgtcagttccctatgactcatttgttaattcccctgtggctccctgcttaaaaccattatgaagatgtcagaccaaggcagcacagtggtcatgatgtcaagcacaatgtttatggtagcatccctcttctcccttcccagagagcaaaatagtaacaaacagcaagggggtgtcaacaagctggggcaacaggcctgccaggcacactggaaactgacaaccagagcatccctcaggagctacctcatgttcctggtggctttgatggggacatcttcctctactcaccctctctccactgagtactttggaattcccaaagcactgtgtaagtttgtaaggcataatggaccatgtcttcttcagttcatcaatttttctagaaaaggtagaaacaggtatctttggtcttatggttttctcaccttagaaacttttccatgaatgctctcaatctttaccttgaacagtatcattgcaggtcattggggccctccatccagcccagaaatgtgacgtattaacacctcaacgtgcccaatgaaggtgcccctgccccattgtggtgtccccatctaatcctgagagaactgagaactcctgtatgcatccacattaggcatggtctcctgctctaagctgtgttgtcacccttgtttattgctaacatgtctctgtgtctacctactcattgtgtgccaacaggcctttctttttttaattttttaattttaattttaattactttttgttttgttgggttttgctttgttttgtttgagacaaagtctcactctgtcgcccaggctggagtgcagtggtgcgatctcagctcaatgcaacctccgcctcttgaattcaagtgattatcttgcctcagcctcctgagtagctgagactacaggcactccacgcccagctaatttttgtatttttagtagagatggggtttcaccatgttggccaggctggttgagaactcctgacctcaggtgatccacccacctcagcctcccaaaatgctgggatcataggcatgagccaccgcgcccagcccctgggtttttttctttttcttttctttttgttttttctttttctttttctttttttcttttttttttttttttaatcgagacaaggtctcactctgtctcccaggtgggagtgcagtggcccaaaattgtggaatcatctcaccattataagcctgtaagaatgtctcattagattactctttaatttttaaaattgttttaattttttttttttcaaaacatagtctgactgtcacctaggctggagtgaagtgctgtgatctcggctcactgcaccctcgacctgcctgagctcaggtgattctcctgcctcagcctcctgagtagctgggattacagccctgtgccaccacgcccagctaatttttgtatttttagtaaagacggggtttcgccatgttggccaggctggtctcaaactccagggctcaagcaatctgcctgcctcagcctcccaaagtgctgggaaccaccaacacctggcctgttttaaaattatttttaattttttattattttaactttttaatttttttaatttttgtttttttaaaatttttaaatatttattttattccatttttaaaatgtttaagtttttaaatttcttaaaggccttaccagtagcatcatgtcgtactcatcctcttcttgctattctaatcttctccctccctacatatatacacacacacgtacacacacacacgtacacacacacacatgcacgtacagcaacactccagcccattgcctcacagattgctatgcaccaacaggcctaaaattaaaatagtaatagcaatgtagtcacaaatataaaataatataaaattattctgccactaagatctttttttttttgagaaaaatacaactttttagagcaaaaatatagggcagcaacaggaaggctcattttaagctgttacgctgcgtagagctgcaccttcacatggcctgtgaaaatacctattcactgaatttggattgtaatcaataattaccagcctagaagacctctgaaagtttgatcattttcttccctctgggcaggcaaatcttccctgcatagagacactgtgagctggaagggagttccttctctcagtgcgtcctctgtgcctgcttttcccatttgcgtttttgagagttcagaactccaggaaggatcatcctatgctggagatttccccgtgaacgtttccttctgcacagagcaaatcagggagacttggcccctctgttccgtctatggactctagaggcgtatctgtctttttagtctgttagccgaggctgttagacatgttggccttagttcttacacagcttgcagagaaaataagattgttatagaaccaatactcatggtctatgggttaatgtagcattggcaagactgcccatgagggcaggcaagggatttaccgtctggcaaaatacaaacaccttagtcttttggctttcagttaacaaatatgacgtcgcatttggccctattacagctacagttaagtgcacacacatttcttttctcccattattcgatttgcacatgctcacaaatccaaaagtaatgacatacttgcattaaaagatatctaaattttgatgagtgttgtaatgaacaggaaaaattattctatcatctacaaatcttttcaaacttgggttttctttgcaaggtccttaagtttcgcctgagtccaatatttcttatgcagcagagacacaatcattgccaactgatcaccatacactggattttcatcctcaataagcccgagtgtaagatccatgcctctgcttcacactcacctgtcttcagtcagtgctcctccttagaggtggtgagcccacagcgatttatatagagtcctgttctcttgttaaaagtgttcatctcatcctattttggagagatttatgacatctcataaattataataataatcataattattataaatactccgaacttatatagggccttttattcgagaatgtcctggcattttgcaaacattaaccaatttgtttcttgccatacctcagaaggcagatcctagttgtagtttaactttgacacattgaggtccaacacttgtctttattcacatcattttctgggaatgtgggttaggtaagaaaacaaggaaggaagagagagagaaagagagagagagtgagaaggagagagagagtgagaaggggaagggaggaagggaagaggaagggaggaagggaaggaagaaagaaaaggaagaaggaaggaaggaagggagggagggaattgaacttggtgtgtcagaaactcattattggtttgtatttcaggtaagcagagcgcctagaccaggggttggcagctttttcttacagacccagacaggtttttgggctacgtggtctttataatgcctctgacattgtagcatgagagtgatcatagataatatttaaatgaatggccaagactgtgttccaaaaaaaaaactttctttactacacaggtggtggccctagggccgtaggttgctggcccctgttctgaaccaccgagagataccagttcacatgtcctcagttcagcaatgtggggagagatgatcggctggatgatgctattttacagacacccaggacctacagcgtgttccaaatgtctacatcaataagtactttgagagggttcatatgaagtttccaggaaggattctttcccaagttgtggaaagggtgcatttcatgactgaaagagggagccccctccctcaccacaccctgtgccccagctcagctgaacagcttgattttccccaaacacagcgccattctttgcactaggcattcctacaggatctttcctttttatctaaaccctcagggacaggggctgtgtctcattcgtctttataataccagcatgcaacactctgcatgatacatattagacactcagtaaaacacgtggaatcaatggcttgcttatcggctgactggtatacagtctgtttcttctgcatcccctgccttagctccctccccataccacaactcaaacacaagctccgtgagagctgtgaatctggctacttcatttataagactgagtcttcagtgcccagataacagcctggcacactgtaagtgttcagtaaatctttgttgaatcagtcaatgactgaagaattcctacaacctcacccagcaagatttggactgggcttccaatgctgggccccaggttagacgtgtgttccttgtgtttcaagcaacatgtggatatttctaccatagcacctacagcactttggtttgttgttgtcttgagaacaaaaacaaaggcttttttctcctgtattccttatggcacataaggggtattcagtacatgtttacggaatgagtaaatgaatgatttaaagcgtatttatgactttttggaagtcactcactctgcatccccagtgcagacattgagggttaagattttgttattctcagccgggcacagagcctcacgtctgtaatcccagcgctttgggaggccgaggcaggtggatcacttgaggtcaggagttcggaccagcctggccaacatggcgaaaccccatctctactaaaaatacaaaaattatccaggcatggtggcacacaccagtaatcccagctactcgggaggctgaggcaggagaatcagttgaaccaagagggagaggttgcagtaagccaagatcatgccagtgtactccagcctgggccacagagcaagcctccatctgaaaaaaaaaaaaaagaagattttgtttttctctacttgtgactgagatggtgagaccacaaggcagggcactgtgagcaagggtccagatttggacacccagggagttcctgaactttaactctgggaggggagtgtgagaacactgggttcctctcggttgttggcagagttggggtaaaaagagaactaatgcacccattaaaaactctatcctgacccccaaaatggaactcatccattttattttttccaccaagctctagcacataccaacaattaaaaggtattacagtgtggggaaatctggggatgcccagctccacctacaaaagcaccctgtcatcagcccagagggccatgttagcatcctgggaggttctcctgggcagcagccagcatgttgcctggcaaaggctccacagagacgaaatggcttctcacaaaccctgcctctctatgatgacttccacctcctcacctgctgcacctgggtccccaccctaagaatcctagaagctgaggaggtcgttctccatccagcctccgggacactccgcaggcacatgacggtcagatttatgttttaaaaagtgtcccctggctgctgattgcattggaggtgagccagagtgactcgggagacttcacagaagaccagaagagagatgatggttggactagagtgacggggctatggcttggctgtgtctccactgaaatctcatctcaaattgtagcttccataattcccttgcattgtgggagggacacagtgggagacaattgaatcatggaggcagtttcccccatactgttctcctggtagtgaataagtctcaagagatctgatgattttataagaagaaaccccggccgggcacggtggctcacgcctgtaatcccagcactttgggaggcccaggcaggcggatcacgagctcaagagatagagaacatcctggctaacacagtgaaaccccgtctccactaaaaatacaaaaaaattagccaggcgtggtgggggcacctgagacttcaggggattgttgggaaggcaagattggttttgaaatgtgaggacatgagatttgggaggggtcagaagtggaatgatatgatttggctctgtccccaccaaaatctcatctcaaattgtagcttgcataattgccttgtgttgtgggagggacccagtgggagacaattgaatcatggaggcagtttcccccatactgttctcatggtagtgtataagtctcatgagatctgatgattttataagaggaaacccctttcacttggctctcactcttctcttgtctgctgccatgtgagacatgcctttcaccttccgccatgattgtgaggcctccccagacaagtggaactgtgaatctgttaaacctcttgcttttgtaaattgctcagtctcaggtatgtctttatcagcagcatgaaagtggctaagagaaaaaggaaagatattacagatctattttagaggtggaattgacaggactcagtttgggacaagacgccaaggatgagagcaaagaagaggacataagtgcctgggaggatggtactaagtctggaatgctgaagatgaaagcacatttaccaaagaagatgaagttttaggctgggtggagtggctcacgtctgtggttccaacactttaggaggtcaaggcacttcaagaccagcctgggcaacatagcaacatcctgtctcaatttatgaaaaagaaaaagaaaggattatgttttaactcccatgtaacaaacctacacgtgtacacctcaatctaaaaatgtttttaaagagaaaaaataacaaattgtggtgtagatatggagaaatggagcccttatacactctaggtgggtatatacacgaatctagccattatggaaaacagtatggagatgcctcaaaaaattaaaagtagaagtggcatatgacccagaaatctcactgctgggtatgtatccaaagaaaatggatatgtcaaagggaaatatgcactcccatgttgactgcagcattatttgtaatagccaagacacagaatcatcctaagtgtccatcaacacatgagtggataaagaaaatgcagtatatacacataatggaataatattttgtcattaaaaagcatgaaatcctgtcatttgcagcaacacgatcaacctaaaggacattaagtgaaataaggcacagaaagacaaaatcacccatttgtgaaatctaaaaaagttgatcatgtgtaatggccaggtgtggtggctcacgcctgtaatcccagcactttgggaggccgaggcaggcagattacctgagtcgggagttcgagaccagcctggccaacatggtaaaaccccgtctttactaaaagtacaaaaattagccggacatggtggtgggcacctgtaatcccagctactcaggaggctgaggcaggagaattgcttgaacctggaaggtggaggttgcagtaagccaagatcccgccactgcactgggaaacagagcaagactccatctcaagaaaaaaaaaaggcgatctcatagaagtaaagagcagaatagtggctactagaggctggggaggaatggggagagattggttgcatgcaaaattacagctagataggaggagtaagttctggtgtcctattgcacactgcagtgactatatttaacaatattgtagtgtatactacaaaatatctaaaagggaagctatttagtattctcatcaatttgaggtgatggatatgctaaataccctgatttgatcattacacaacttatcccataaatctatgcaattcttatgtataaattaaaaataaaacttttacaaaatatataatatctttttattttgagacggagtctcgctctgtcacccagatggagtgagcgtgatctcagctcactgcaacctccgcctcctgggttcacaccattctcctgcctcagcctcccgagtagctgggactacagtagcctgccaccatgcccggctaattttttgtatttctagtagaggcggggtttcaccgtgttagccaggatggtctcgatctactgacctcatgatccgccggcctcagcctcccaaagtgctgggattacaggcatgagccaccacaccctgcctcatgatttcttataagtaaaaaacacacaaaaaaggagagaccagagaattgaatccagccatctaaatggacattgaacccactcagcatgacagagtcaagaataagactttgagacaagtgtgaacgttttcttgaaaaagtgaggatccaggaggtctgaaaggacaagccagggacatggtggctcatagcacaagtttctgagacacagcccctgtccctgaggggttagataaaaagcaaacagcctgtaggaaggcctaatgcaaagaatggcgctgtgtttggggaaaatcaagctgcttagttgagctggggcacagggtgtggtgagggagggggctccctctttcagtcgtgaaatgcaccctttccacaacttgggaaggaatccttcctggaaacttcatatgaaccctctcaaagtacttattgatgtagacatttggaacatgctgtaggtcctgggtgtctgtaaaatagcatcatccagccgatcatctctccccacattgctgaactgaggacatgtgaactggtatctctcggtggttcagaacaggggccagcaacctacggccctagggccaccacctgtgtagtaaagaaagtttttttggaacacagtcttggccattcatttaaatattatctatgatcactctcatgctacaatgtcagaggcattataaagaccacgtagcccaaaaacctgtctgggcctgtaagaaaaagctgccaacccctggtctaggcgctctgcttacctgaaatacaaaccaataatgagtttctgacacaccaagttcaattccctccctcccttccttccttccttcttccttttctttcttccttcccttcctcccttcctcttcccttcctcccttccccttctcactctctctctccttctcactctctctctctttctctctctctcttccttccttgttttcttacctaacccacattcccagaaaatgatgtgaataaagacaagtgttggacctcaatgtgtcaaagttaaactacaactaggatctgccttctgaggtatggcaagaaacaaattggttaatgtttgcaaaatgccaggacattcttgaataaaaggccctatataagttcaaagtatttacaattattatgattattattataatttatgagatgtcataaatctctccaaaataggatgagatgaacacttttaacaagagaacaggactctatataaatcgctgtgggctcaccacctctaaggaggagcactgactgaagacaggtgagtgtgaagcagaggcatggatcttacactcgggcttattgaggatgaaaatccagtgtatggtgatcagttggcaatgattgtgtctctgctgcataagaaatattggactcaggcgaaacttaaggaccttgcaaagaaaacccaagtttgaaaagatttgtagatgatagaataatttttcctgttcattacaacactcatcaaaatttagatatcttttaatgcaagtatgtcattacttttggatttgtgagcatgtgcaaatcgaataatgggagaaaagaaatgtgtgtgcacttaactgtagctgtaatagggccaaatgcgacgtcatatttgttaactgaaagccaaaagactaaggtgtttgtattttgccagacggtaaatcccttgcctgccctcatgggcagtcttgccaatgctacattaacccatagaccatgagtattggttctataacagtcttattttctctgcaagctgtgtaagaactaaggccaacatgtctaacagcctcggctaacagactaaaaagacagatacacctctagagtccatagacggaacagaggggccaagtctctctgatttgctctttgtgcagaaggaaacattcatggggaaatctccagcataggatgatccttcctggagttctgaactctcaaaaacgcaaatgggaaaagcaggcacagaggacgcactgagagaaggaactcccttccagctcacagtgtctctatgcagggaagatttgcctgcccagagggaagaaaatgatcaaactttcagaggtcttctaggctggtaattattgattacaatccaaattcagtgaataggtattttcacaggccatgtgaaggtgcagctctacacagcataacagcttaaaatgagccttcctgttgctgccctatatttttgctctaaaaagttgtatttttctcaagaaaacatgatcttagtggcagaataattttatattattttatatttgtgactacactgctattactattttaattttaggcctgttggtgcatagcaatctgtgaggcaatgggctggaatgttgctgtacatgcatgtgtgtgtgtgtgtgtacgtgtgtgtgtgtatgtagggagggagaagattagaataacaagaggaggatgagtacgatgtgattcaactggaaaggcctttaacaaatttaaaaatttaaacatttttaaaataaaataatttttttttttgagatggagttttgctctgtcgcccaggctggagtgcagtggtgcaatcttggctcactgcaagctccgcctcccgggttcatgccattctcctgcctcagcctcccaagtagctgggactacaggtgctcgccaccacgcctggctaatttttagtggagacggggtttcaccatgttagccaggatggtctcgatctcctgacctcgtgatccgcccgcctcggcctcccatagtgctgggattacaggcgtaagcagccgtgcctggccaaagtaaaataaatattaaaaaaatttaaaaacattaaaacaaaaattttaaaaaattaaaaagtacaaataataaaaaattaaaaatagctttaaaataggcctggtgctggtggttcccagcactttgggaggctgaggcaggtggattgcttgagccctagagtttgagaccagcctggcccgcatgacgaaaccccgtctttactaaaaatacaaaaattagctgggcgtggtggcacacgattgtaatcccagctactcaggaagctgaggcaggaggatcacctgagctcaggcaggtcgagggtggagtgaaccgagatcatgtcacttcactccagtctgggtgacagtgagactctgtctcgaaaaaaaaaattaaaacaattttaaaaattaaagagtaatctaatgagacattcttacaggcttataatggtgagatgattccacaattttgggccactgcactccagcctaggagacagagtgagaccttgtttcaattaaaaaaaaagaaaagaaaagaaaaagcaaaaaacccaggggctggacatggtggctcatgcctgtaatcccagcactttgggaggctgaggtaggtggatcacctgaggtcaggagttcgagaccagcctggccgacatggtttatcttcatggcctcaggcacatttcttttttctttttgctttttttttgagacagagtctcactctattgctcaggctgaagtgcagtggtagaatctcagctcactgcaacttctacctcccaggttcaagcgattctcttgcctcagcctcctgagtagtgagattacaggcatgtaccaccacgcccagctaatttttgtatttttagtagagatggggtttcaccatgttggtcaagctggtttgaactcctgaccttaggtgatccacctgcctcagcctcctaaagcgctgggattacaagcgtgagccactgcacccagcctcctcgggcaaatttctgagtcggctttgtcgtctgtaaaatgggaataaaaagagtacctacttcacagggttgttgtgatgattactcaaaataaaatatttgtgaaagatcatgacaatagtagcacaactaactcatcacaatgcctggcatgtaaatgttacttgttaactaaaaataaataggtctttgagaaggttaaatgggacgtacagaataaacacatccatggcagtgccaggtacatgtgtagaaatagaatatatgatctctttggagcagaagattttggggttttctttttttgagtcagagtctcactctgttgtccaggctggaatgcagtggcccaatcacggcagctcactgtagcctccaactcctgggctcaggtaatccttctgcctcagcctcccaagtagctggatccttggcctcgcaaagtgctgggattacaggcatgagacaccactcctggccagagcggtggttttcaatggctgctcattagaatgattggaatcactaatgtgattccagcctactccctggaacctatgtacatgttaagttacatggcagaggagactccagttagtagatggaattaaggttcctcatcatctgaccttaaaagagataggatatcctgaattatcaaggtgggcccttaaatgtggaagatggaggcagaagagtcagtttcacagagatggaaccagctcttgctgcctttgaagatagagggaaggggccaggcgctagggactcttgtctctaaaaataaataaattaaaaaaaataaacttacattgttttaagccaccaacattgtggtaatttttacagcagcagtgggcaacgcagccacatttatgaaccactgcaggaggggttctgctgcctcttggccatcgtttgccaaaatcttttctccgttccttcctgagaggcaaaggctagtcccagctgtttccagtcttcttgatcagaatttttccctttacttaagagattcaccctgctttagttgtaatttgtgtcttttttttttaagagacaggatctccctctgttgttcaggctggagtgcagtggcacaatcatagttcactgtaacctcaaactcctgggctccagtgaacctcccatctcagtctccccagtagctgggactacaggtgtgtgccaccacactgggctaatgtttaaattttgttttccaactggtcttctgacacaggagaatttttttatcttttgtggagatggggtcttcctatgtggcccaggctggtccccctgcctccttttttttgaggcagggtctctctctgtcttccagactggtttgcaatggtgtgatcacagctcactgcagccacaaactcctgggatcaagtgatcctcccacctcagcctctcaactaactagaattacaagtgcgtgccaccatgcccggttaatttttaaatattttgtagagatggtgggggagggggtctcactatgttgcccaggctggtctcgaactcctgggctgaagtgatcctcggctttgacctcccaaagacgagattacaggcatgaaccaccacacccagccctcaggctggtcttgaactcctggcctcaagccgtcctctatccttggccttccaggcatgagccaccatgcccagccctcaggctggtctcgaactcctggcctcaagccatcctctgtccttgacttcccaatcccctgggattacaggcatgagccagcatgcccagcctgatttttgtctttatgatcagatccttattgttgctatgcaatttaaaacttagaaaaccatagttttaagtaacaaagttttattatattagcccaaggatgctaatgacaagctcaaaattatttgtcagttggtttaaaaatacatgaaaagagttaagcatttatatcctgtataataaaaaaggaaaaataataatacacatttaatcagacagttttatgaaggccataagttgtttgtttggatgaacctgggaggctgagggggctcaggcccctcagagaaggggcagaaagtagggatggaagaccctggcagtcatctctaagggaagggaagcccctaaaggggccagccctagcaaagaaatagcaggaagagccttggttccctctcacctcttcaaccactctccactgaccaagcccacaccccttattctgtggacattttcccactaaaatatttcacttggcactttgggaggctgaggtgagtgagttacttgaggtcaggagttcaagaccagcttggcaaatatggtgaaaccccgtccctactaaaaatacgaaaaattagctgggcgtgatggtacatgcttgtactcccagctactggggaggctgaggcaggataattgctcgaacccgggaggtggaggttgcagtgagccaaaatcgcaccactgcactacagcctgggcaacagaatgagactccgtctcaaaaaaaaaaaaaaaaagaaagaaaatattttcatatgtaccatctgcacaatagaacactttgcattaattagagaggtggcactactgtgatgacataagaaaatgtgctggctgtacaggtaaatgggaaaaaaacaagttgcaaaataaaatgtactcagtgaccccattttaacaaagacaaatgttagtgtatgtctagaaaataaaaatttgggagaaatgcatcaaatcttgaaagaagttatctgtggagatgagactagagaacatgcttattttacatatttcatatttccttaatgattgacattgtatgccttattgctttcataatcagaaaaaataattgtataattaatggtaaaaactgccaaccaaggctgggcacggtggctcatgcctgtaatcccagccctttgggaggccgaggcaggaggatcacctgaggtcaggagtttgagaccagactgaccaacatggagaaaccccatctctattaaaaacacaaaattagccgggtgtggtgacgcatgcctgtaatgacagctactcgggaggctgaggcaggtgaattgcttcaacccaggaggcggaggttacattgagctgagatggcaccattgcactccagcctggacaacaagagcgaaactctgtctcaaaaaaacaaacaaaaacaacaacaacaacaataaaacaaacaaaactgccaaccaagtcttttttcttcttctattttttaattgaaatagagacagagtcttgctttgttggccaggttggtcttgagctctcggcctcaagtaatcctctcaccttggcctcccaaagtgctaagattactggtaatcatgcctggcctaatccagtctttccccctacttttccctagacatttagaatatggtgatatatagtgatagggttataaaagtcagtcattttaaattgtatccctaaataaatgcctgtaatcaagaccatcttgtgctgggtgcagtggtacatgcctgtagtcctagctactcaggaagctgaggtgggaggatcacttaagcccaggagtttgaggttatggtgagctatgaccaccactgcactccagcttgggcaacagagtaagacctgtctcttaaaaaaaatcttctctcagcagatcagccatcaaaattattgttagcctgatgaaatataggtgggcatacaatgttagaagccaccctgacctctgcagggactccaagtcctcataagcacaaacagttctagcctgccattgacagtttaaagagggtgtccttttgtccctcctacatttctctgtttattcatatccttcacatttttctttcttttgacctatttcattcctaaaatattctaacatctgacttctctcccaattacaatagtaacaatacatcatgggttttccagtgtagttactttttagtatatattttttcaataatggctattcattaaatatatatgatttgttttggggccactgaaagacttcatataggtaagttcatatcatactgtgataaagtttttggtttttggtaatgaaaacatggattttgcactgattgctctgcggaatttctctctggatgatgcttgatgaccttcacatggcctcttagtctttttttcaatttacctcctttgcagcctttaaaactgtgaatcaagtcttcctgtttcaaatctccttccttagttttcatgaatctacactgtccttcctctgtaaatgcttctttggccctccatatccttgggttctgcatctgtggattcaaccaacagcagatggaaaatattccagaaaaggaaaaatatctggctttgtctgtacctattaggtgtagactttttttgttgtcattattgtctaatcaatacagtataacaactatttatatagcatttacaatgtgttaggtattatacataatctggagaggttttaaagtgtacaggagaatatgtggcaggttacatgcaaatactacacctttttttttttttttttttgagacagagtctcactctgtcacccaggctggagtgcagtggcgcgatcttggctcactgcaacctccacctcctgggttcatgcaactctcccatctcagcctcctgagtagctggtactacaggcgcatgccaccacgcccagctaatttttgtgtttttagtagagacggggtttcaccatgttgtctgccttttttattataatcatcctggctggtgcaaagtgggatgtcattgtggtttggatttacatttccctgacagttaatgatttgagcatcttttcatgtacttactgcccaactgtccatttcttttgggaagacgtacagatcctttactcattttttttttttttttttgagacggactctcactctgtcgcccaggctgcagtgcagtggcatgatctcggctcactgcaagctccacctcccgggttcatgccattctcctgcctcagcctcccgagtagctgggactacaggcgcccaccaccacgcctggttaattttttttttttttttttgagatagagtctcactctgtcacccaggctggagtgcagtggcgcgatcttggctcactgcaagctctgcctcctgggttcatgccattctcctgccgcagtctcctgagtagctgggactacaggcgcatgccaccatacccggctaatttttttttttatttttagtagagacggggtttcaccgtgttagccaggatggtctcgatctcctgacctcgtgatctgcccgccttggcctcccaaagtgctggaattacaggcatgagccaccgcgcccggcccctttactcattttttaaattgggtatttatattctttttattgggttgaaagaattctctacacattccggatacattttatcagatatatgatttgcaaatatttttccaattctgagttgttattctaatctgttggtatcaattgcagcaagtgtttttatatttggtgttcatctatttttcttttgtgacttgtcacatcaacaaggctttgtgtaacccaaagtcgtgaagatttacccttagatattcctcttagagttttatagttttaattcttatatttaggtgtttgttacatttcgagtttaacttttgtatatcgcataaaggaggggtcaatatttacttgtcccaaaaccatttgttgaagagactattctttcccatttgaattgtcttggaacttttgccaaacatcaactgactacaaaacacaagggtttatttctggacttttatttcgcttatctttatgcctgtcttataattgtagttttgccctaagttttgatatccgagtgagtactccaaatatgttatttatcaagattattttggctactctgggtccacataaattttaagatcaacttgtcaatttttgcaaaaaggtatctgggagtggaggtttttgtttttttgaatttgttgaatttgcagattaacttggcaggggcagtattacaatcttaagacttagtatcaagtcctctgactcataaaataaagctttgcatttctttttcttttttttttttttttgttttaaacttaagaacactgaaaaatgaaaaaacaaaaacaaaaacaaaaaacaaaatagagacaaggtcttgttctgttgcccatgctggagtatagtggtgcaatcatagctcactgtagcctcaaactcctgggctcaagtgatcctcttgcctcagcctctcaagtagttatgaggtggatgccaccacacctggctaatttttaaaaattttttgtagagatggggtctcactatattgcccaggctggttttgaactcctggcctcaagcactcctgcctcaagctccaaagcgctgggattacaggagtgagccacagcattgggccaatgggttttcttatacacaatgagtagtttttttttctgttttcaagatttttttctttcattgttttcactatagttttggtatgcatctttctatgttatcttacaacttgatcttggattaatgttttcatcaaatatttgattttcaggcatcatttcttccaataatttgctgattctttctactgtgaacacaatctactgtagagctcctctaatgaatttttcattacagttactttacttttgaactctagaatttctatttggcccttttatttattttattttatatattttttgagatggagtctcactctgtcgcccaggctggagtgcagtggcgcaatctcggctcactgcaagctccgcctcccgggttcacgccattctcctgcctcagcctccccagtaggtgggactacaggcgcccgccaccacgcccggctaattttttgtatttttagtagagacggggtttcacggtgttagccaggacggtctcgatctcccgacctcgtgatccgcccgccttggcctcccaaagtgctgggattacaggcgtgagctaccgcgcccagcctatttggcccttttaaattcctttctttgttgatattctgtttgatggaatattgtaagcataccttcctttacttccagcagtttcctttagttttttttggaacacacttataataatgctttgaagtttttatctgcttccaacctattgaccctctcagtttcctttgattgctttttcgctccttgtatggattagtttcctgttcttctgtatgtcttgtagtttgttgttgaggactggatattttagacactgtgtcacagcagctctggatagtaatttccctccaacccctaccctctgccctccagcgcatttcttcttgtttagtttcttggctggatgatttcagttaagtccacttaccctgaagtatgcaggctctgatgtccctcctcagagtacagtctgggcgtgtgcagtcaccatgactactccctctagccccaaggacagtggttttgatagggctctcttttaccttttcctgatctttcgggaaaggttctagttagttagaacctcttttgttatcacatcctactattagcacccactaatttactagctaaccactcattttttttttcattttttatagagacagggtctcactatgttgccgaggctggtcttgtactcctggcttcaagtggtcctcccgcctccgcatcccaaagtactggtattacaggcatgagccaccacacctggccactcttttgtttctgacaatgctctggggcacaagtcgccgcagtttaatccagttaaattcaggcccctgtagagtatctttgaggcttgtcttaaacctaggactaataacagctgcctctatttttttgagacagggtctcactccgtcacccaggctggggtggagtggtgtgatcttggcccactacaacctctgcctctcgcgttcaagcgattcccatgactcagcctcctgaatagctggaattacaggcacgtgccatgatgcctggctaatttttaaacttttagtagagacagggtttcagcatgttggccaggctggtcttgaactcctaacctcaagtgatctgcccgccttggcctccccaagtgctgggattacaggtgtgagccaccgtgccaggctctttctgttgagcttgttggcattcccttttgcttgttgccatcagggagctgtcaatacgctcttaattgctcccctccccagatccaacgtatttggtggcacctttacacttcaacatcttccctcattctattctagtcagtccctttattaaatatttttagtagagacggggtttcaccaagttagcgagaatggtcttgatctcttgaccttgtgatccacccacctcggcctcccaaagtgctgggattataggcgtgaggcaccgtgcccggcccagagctgtttttatgacttgccatttccactggacagaacctctgttctgctgctccagagctacgggtggggacagtggcctgcttttctaggagttatactcacagtctacaagggggaaaggggtgatataacccctggtctcctccaagtgcatctccttgcatggaaccttcactctacgtacgagtaaagagccttcatcctatgagtaagctggggcaaaagcaactaaggcccagtattctcagtctgatattcctgggttagagtttctgtgctgtaagtggggactaggtggaggaaggagtgccaaacctcttggctactcttgcttgcaaaagggcttctgcaacacagagcttcagggaatgaggcatgctaataatctactcttccagaggagaaactgtagtccaggattgggaactggagagagggaatggggtcatggctccaatgccacagactccctattctaaaagattgactttcttgaaaaactgtttttgttggatgtatgcttttatgacaatttccacataaacttccagttacaggtattttattgagcagagacagtgaagttccttatgctgttatttcaaaagtgtttcctggtttctttttaatgaatgtcttaaaatacaagcaatcaggaccctttaaataaggcagtatgttcacaaatcaaaatagctttctgctggcatcagttgattcaacatcaacatgcagtgtccagaatgaataagcagttctttaatggttatttaaatatattccagaagagcgtttataattcatttacaagtgcagtattgcgctagtaaatgttacttgacctcttgtataaataatgccgattaagaattagtcctggaatagttttcgaatttctaactctgtagatctaaaacacaattgtaaatggtataaagatgtaagaatcatattgtgataaagtcaatctcaaaaatagagaatccagacccttcccagataatttaagaactgagttttcctcaacttaaacatgatggccacacagaaaacagtaaagacacttttcgatgtgatacaactgtataaaactcgagaatatgagtatttaggtgaccaatgtatagacattaatagaattttaaaaacacatttaaatctgaagcagaaaaaaaaagacaatttacaaagaattattgagctctaatcatcatcagagtctgaatcatatttctttcctcggatagttttcttttccagctttgtgaagtttgttccaaatttcttttggttctgaaatggtggctccattaaatttccacttaaaaaaaaaaaaaagcattttattctttatgatttagtactagtatactaaactgcacaaaaatctatctttgttttcttcctgtaacatagaataaaatttctttaaaatgctggtgtcagggaagaggtataatgcttatattgatattgatggttaatagccttaaaccttattgtgtcctactgaatgttttagatcaattttattttcctttctttttgagacagggtctcactctgtggcccaggctgatgtgcagtggtgtgatcacagctcactgcaacctccagttcctgggctcaagcgatcctcccacctcagcctcccgagtagcttggactacaggcgtgtgccaccatgctcagttaatttttacattttttgtagtgatgacatctcactacattgcccaggcttgtcttgaactcttaggctcaagcaatcctcctgctttggcatcccaaagtgctgggattataggtatgagccactgcaccagacctattttcctttttatcattaattatggattaacatttggttaacacagtgctcagttgtcaccggaaatgagagaaaccatcacacacctcccgatatgatgcatcacttccataatatgcccgtcaaaaatcgataatctgaatctaatcttgaggaaatttaagacaaacccaaactgggagatgttctccaaaataaacagtttgtactcttcaaaaacatcagtcttaagaaccaaagaataacaatggtaactaaagacgtaataactaaatgtgctgcatttttggtatgaaggacaattattgggacaatgagaaaacttgaaataagagcggtaaattacacaataattcctgtttcaataattgtactgtcgctacgtaagaaaatgttcttgttcttagaaaatatatatggaagtctttaggagtaaagggacactgtattcacaatttccactcaaatggttcccaaaatacttcatagtatctataaagacaatgataaaacaaatataaaatgtttaaaattgggtaatatgggcaaagggtcaatgaggattcgttgtactagtctgcagggggttgtttctactagttttttgtagagacgaggtctcatctcactatatgttgcccaaattggtctcaaactcctggcctcaactgattctcccacctcagcctctcaaagtctgtaatcttctgagattacacaagtgccccacccggctgcaatttgtttaaggcttaaaattacttcaaaatatataactttatttaataaatattaatattttatgttaatattaaggaaatgaaaccaatttctacaacataggaatgatttcggcatgtctaggagagtcagagaaaagacgggagggaaatgggggagaaagaaaaacgtgagagaaccttctacttcctgaaaggcaccatgactctggaatggtaagtgcacaattttacctgttacttttgcaaatcaagaaaaggcaaaaaagacaagatgatatgctctgatttgtggaattagataaattatttgtctgaagaagtggacaaagaaatggaagttggattttagattgttttcaaactaaaactgttcttcatagcaagcaatgtaagctaggcatagaaacctttttctattcatcagcctctataagtaaaacagaaatatccatgttaaaaatctagtattttaaaatataactttctttgcaagagtctgcttttaatttttattttatcaaagagaatcacttaagtcagaattcatttgagcaatctggcttaaattggggaatagtcaacactggattgccattttaagtttccagattaatacaaaattagtgtcaatagtatacgttaagctgaaaacttttatagtcaggagtacggtgagactcagttttacctattaaatcagtttaatctgtaaatctgattttgccgtaaaatcacgctaatattacacacttcaaaaaaacatgcttttcctttgagaaactttccacatctcagccaaaatgccttaatttcataaaataaatgttacaatacaaaaatcttttgtaaaaatatcaactatatatgaattaaaatcaatctcttcttttgttaaaagttacctgtaattaagaatgtcagaagaaccgagcctccattctaaagtttctgtggtgaagtcatctgtatttcctaggtcagtaaacccaacaacataatcttgtgttttcccatcttttagcagtgctagtgtgggaatgactttgatatgcagtctctcacaaaggaaaggtgctttttccacattcagcttcaaaaatttggtctcgaggtgtttcttggacaatattgccagatgtctgtctagtattttacacctgtaagtgaccacacatagaaaattataagctaaaaccacagatcgcttttttcaaaataaatatcatcaagggaaatctaattatgtagtttttctgttgactctcataacatggcagccaacttaaacttgtgtcagatgacctcacttccagatcagaggttagctgcctgattacgagatgggaaaacagcctataagattctagaaagtcagatttgcattaatgatattctcttttaaaatattaaatatatgctttaagtcataaaggaagttgtcctatctcctacacaggaaacttgaagaggaacaaactgaaacttgacaaaactcggaagagacttacaagaatcagaagtgcacacatggtgccatatttggaagtcatgaagaaaaactgaacagcattaccgaggaaaaacttcttactcctaaatatgcaacgctgtcagtaagaagcacattaaggctaagggttactaataatatttaaataaatgtggccattatgcttctaggaaattaaaaaataccagtagtaacttttttattttttatttttttggaggtggcgtattgccctgtcccccaggctggagtgcagtggcacaagctcggctcactgcaagctccgcctccctggttcatgccattctcctgcctcagcctcccaagtagctgggactacaggcgcctgccaccatgcccggctaattttttgtatttttagtagagacggggtttcactgtgttagccaggatggtcttgatctcctgaccttgtgatccgcctgcctcggcctcccgaagtgctaggattacaagcgtgagccactgcacccagcctaccagtagtaacttttattaagccatcttccaatgaagacggaaacagaagtgagattttcttggccaggtgcggtggctcacatctgtaatcttggcactttgggaggctgaggcaggcggatcacttgaagtcagtagtttgagaccagcttagccaacacggtgaaaccctgtctctactaaaaatacaaaaattagctgggtgtggtggtgcatgcctgtagtcccagctacttgggaggctgaggcaggagaatcacttgaacctgggaggtggaggctgcagtgagccgaaactgtgccgttgtactccaacctgggcaacatagtgagactccatctcaacaaacaaaaaaagtgacatcttctttacattaaaatttattttctggcctgatgcagtggctcacgcctgtaatcccaacactttgggaggctgaggcgggcagatcacttgaggccaagagttcaagaccagcctggtcaatatggtgaaaccccatctctactaaaaatacaaaaattagctgggcgtcatgatgggcacctgaaatcccagctacacaggaggctgaggcacgagaatcacttgaacctgggaggtgggggttacagtgagctaagattacaccactgcactccaggctaggcgacagagtaagactctgtctcaaaaaattcattttcaactggccaattcacgagtgtttctaaaacagactattgtaacaatcttttagaccggtggttcttaaccccaggtgttcattatgatcaacttttatttattcatcttttttgagttggactctcactctgtcacccaggctgcagtgcagtggcgcgatctcggctcactgtaatctctgcctcctgggttcaatcgattctccttcctcagcctcccgagtagctgggattacaggcacctgccaccacgcccggctaatttttgtatttttagtagcgatggggtttcaccatgttgactaggctggtcttgaactgctgacctcaagcaatccacctgcctcagcctcccaaagtgctgggattagaggtgtgagctaccacacccagcctgccgtcaacttttaaaatatccagatgaatcaaaattctctggcagtggagttgggaaacatacagctgttcttatgctcaaataaagcttgagaactacctctagatgactcacacacaaaatacttcatggttatttttaccagtaagctttttgtgcacttgatgtagtttttcctgaactaagtttggctctaacataagttatgtgtaaccttggtgcctcatcactttttccccggatatgttttttcatatgttactcatgtagttcagtaacgagatttcagtgaaaaatggtaagagagaacaaattaataaatggtttttaaataaagctcaaaacaaatgataaatcaacctttatatgagaaatatgttcctgaaaatttgtaaataaatcaactccatactttaactgcagtaaggaacgtattttttttttgagatggagtctcgctctgtcgcccaggctagagtgcagtggcacgacctctgctcactgcaacctccacctcctgggttcaagcaattctcctggctcagcctcctaagaagctaggattacaggcacccgcaccattgcctggctaattttaatttgtatttaaagagcaagacagagtgtcttgctctgttgccaggctggagtgcagtggcacgatctcagctcaatgcaacctccgcctcccaggttcaagcaattcccctgcctcagcctcctgcacaactgggactacaggcacgagccaccatgcccagctaactttttgtattttagtagagatgggttttcaccatgttggccaggatggccttgatctcctgacctcatgatccacctgcctcagcctcccaaagtactgggattacaggcatgagccatggcgcccaacccgtcaatcaatttttaaaaatccaaaacaacagtcatggtataaatagctataggcctttacgtatgtttaaaaataactaaaagagcataattagattgtttataacacaaaggataaaagcttgaggtgatggatattccatttaccctgatgtgattattaaacactgcatgcctgtgttaaaatatctcatgtaccccatatttacctactactacccacaaaagttaaaaattaaaaaaatagcaataggcttaaaacatgggttccaatctctctcttttttttatcatttagtatctgagtgatactaggtgagtcaatttctccaaatcttggtttccatacatgaaatacaggaataataataagtgcctctgaagattattgtgaatgttctagggataatatacatgaaagcatcctgcctactatgtgctaggaactttgctaatatataaagttcactggatgattttgatttttcagttctgtttgaaggtgagtactcctggtgatgcactgtttatacaccatcaaatgtatttattgaccacctactatgcgtcaggcagttgctttagggctatgatcccagagaacagtaggtcacaatacaggcaaatgcgctgcctctacaaaacgaacaatctagttgggaaagacataaaaaaaacaagtgaggccgggtgccgtggctcatacttgtaatcccaacactttgggaggccaaggtgggtggttcacctgaggtcaagagtttgagaccagcctggccaatctggagaaaccctgtctctactaaaaagacaaaagttagccgggtgtagtggtgggtgactgtagccctggctactcgggaggctgaggcaggagaatcacttgaacccgggaggtggaggttggagtgagccaagatcctgccattgcactctagcctgggtgacagtgtaagactctgtctcaaaaacaaaaaaaaacaacaaaaaaaaaacaagtggacaaataatattttacatactagtatatttatatatcacctcatcatatttgtcagaggttggcaacttgaggaatgtgtgccaatgcgagatggttgtgtaccataagggcagaggtttctctgatacctttctacctgcctaatcccttctctcactgttcctcacaagggatttcaccatctcaatattttgtttcatttttattctcttagtcaatgaataccaggcaatcaattcttgaaaggtgttaactaacaatgaagctgttgggttgtgagatcaagacaaaggggcaagaaggccacagaaatgagaaagagagcagggctgaaaccacagtgagtgccagagactctagagcacagtgcttgtctgtcctgggtaggcaggtgccagtcagcagatgactgccatcatagttccagctatgctattagcaagttttctgattttttaaagaaaaattctaagtgtggatattttcaaaaggagttatctctcgatttttaagtgttggcaactaatcaaatctgtgcacaaaaaaccacaaaggcttgggtcctttggtttacgatgtgacctcttctgaggaggtattaacattttataagagatctgcttccttagagaaatttggagacctagggtggtctaagaaaaatcacttctccttctagccaagactggcagtcccaactctgctctggtgaaaggtttggccaagccaccatctccccaccacagttgctagttccttcaaggaggaactgaaggaacactgactctcaacagctgttgcccgttcccaatatcatggctacatcacaatactagagggaaataattactgtcatggtgataagaattttaagtgtacatttctaagatgtttttagttagctagtgaaaatacaattcaaaaatataagccatttatatgggaatattgactttcagtaatattcatttatacttttgcatgtaactgttctttaagttactctttaaaataacaattaactttttttttctttcttttttgagatggagtctcactctatcgctcgagctgaagtgcagtgtcgcgatctccgctcactgcaacctctgtctcctgggttcaagcaattctcccacctcagcctccccagtagctgagactacaggtacctgccaccacacccggctaattttgtagttttagtagaggcagggtttcgccatgttggccaggctggtcttgaactcctgacctcaagtgatccaccccccacttggcctcccaaagtgctgagattgcaggcttgagtcactgggcccctgcctgcttaacttaatactaaataacatatgagagagtacaatgaaacaacttaggaagttttttcttttagttttcttcatttctctagtaagccagtatatctccagccaaacaattcactgtgtttttttagaaaaagtcacagatggaaacaaagttacctgaatgtggagtctctgtagaaatggcaaaccacattttcactctccttgacttcttgaaaaaagtctctttcactagggatttctctgtattccccatgtcctttagaaagccattcctaatttggagagaggcaaaacattacacatgtgagatatctctttcagaaccacttgacattttaagtgtccaaatcaccatcgtattttgtaatgaagtcaattaaaaaaaaaagttttttttttgtttgtttttgttttttttttttgagacggagtcttgctctgtcaccaggctggagggcagtggcgcgatcttggctcactgcaacctccgcctcctgggttcaagcaattctcctgcttcagcctcccgagtagctgggactacaggcgggcaccagtatgtccagctactttttgtatttttagcagagatgggttttcaccatgttggccaggatggtctcgatctcttgaccttgtgatccgcctgcctcggcttcccaaagtgctgggattataggtgtgagccaccgcgcccggcccaaaagtgttatttatttattttttttttgagaatgggtcttgctaaagttgcccaggatggagtgtggtggcatgatcatagctcactgcagcctcaaacctcctgggctcaagagatcctcctacgtcagtctcccaaggaattgggaccactggcgcatgccacaccacgcctggcattttttttttttttttttggtagagacggggtttttactatatcgcccaggctggtgtcaaactcctcggttcaagcaatcctcccaccttgtcctccaaaagtgctggggttataggcatgagccactgtgcctggctgaagtcaaagaaaaatgaatgttttttagcaatttactttcctgtttctactgtcaatgcaaaactagtctacggacagtgaacgtctccacagcatggcctgggttcaagacaattacctgtctttgtagcttaaaacatctattttctcagaactttcaaaataaaaatttagacttgagagactcagaatgtaaatatccacttaactctatccatgtactcttaaactactaaaaccagaagcatttgatccaagttactacaagtcttttaaaaataatgctcatgaggctgggtgcagtggctgatgcctgtaatcccagcaccttgggaggctgaggcggctggatcacctgaggtcaggagttccagactagcctcgccaacatggtgaaaccccgtctctacttaaaaaaaaaaaaaaaatacaagaaattacctagctgtggtggtaggcgcctgtaatcccagctacttgggaggctgaggcaggagaattgcttgaacccaggaggcagaggttgcagtgagctgagatcacgccactgcctgggcaacagagtgagactctgtctcaaaaataaataaaaataaaaataatgcttatgagataaacccaattcgtcttggggagaaaaggaggatactgcagctctgaagctcaagagccctgtctgcttttgataaccactttataaatgcttaaaaagtctctatacctgcactaattgttagaaaggtcatctcacactgaactgcaatatatccataattctggtctgtggattccagcttggataaagattaaagttttaatctctttcccacgtgggcccttcaaacatcacatattgcctaagttttcccttctccacactgaacacttccagttccttttaactgttctcatatgaaaagatttctagagttcctactcttccaggatatcaactaaacacactctaattcaccaatgtcttcttaaaatgtgacagaggtctgaatccagcctccagaaggggtccaaccaaagagccaggagggccatctcccttcctcctctggacgtcagtgaacgtggcccagactatattgatgactgcggtgtcaaaatcacatccatttacatcgagctgacacttgcaggataccctgatattttcttatgtgaaatttctacacacagtttaactctcaaatacaattccctaatgacatatgacatttcatgactgctttcacaacttaccaatgatatgtgcccttaaaaagtatttgttaggctggacgcagtggctcacacctgtaatctcagcactttgggaggctgaggcaggtggatcacttgaggacaggagtttgagaacagcctgggcaacacggcgaaaccctgtctctacaaaaaatatgaaaattagccaggtgtgttggcacacacctgtaatcccagctcctcgggggctgaggcacaataattgcttgaactccgaaggcggaggttgcagtgagccaagatcacaccactgcactccagcctgggtgacagagcaagaccctgtctcaaaaaaaaaagtatttgtcttttaaaaagctgctatttctaggccgggcgcagtggctcacgcctgtaatactagcactttgggaggctgaggtgggcggatcacctgaggtcaggagttcaagaccagcctggccaacatggcgaaaccccacctctactaaaaatacaaaaattagccgggcatggtggcaggcgtctgtaatcccagctacttgggaggctgaggcagaagaattgcttgatcctgggaggtggaggttgcagtgagccgagattgtgccactgcactccagccggggcaacagagcaagactcttatctcaaaaaaaaaaaaaaaaaaaaaaaaaaaaagctgctatttcttttcattatttattctcaggtatttaaccaagaggctgaagacccgaacctgtcctgggctcctttgagggaggatgtgcccattccaaacctctaccaatgctcagggcctctcctgacacattcactacacccctgtgctcttagcatagccccttttggacagcatgtgctcctaaggtatctgcagaacagaatcaagcaggatgggcctacctgaggcatggcagctgggcagcacctggctgtcagtggctgtcacccaagcctctgcttaactcctatttcttaccttatccctctattctgctccctacctaagtgtgccagctctagttaacagtaggagggtgcttggctgacagaagaatatagattcacctaggtctattaagtgccgactgtaagtcaatgcatacaatgatctccccaataccctcgtggatcagaaaatcaaaattactgcataatctaattactgtataatctcttataaaaagaatatctatacaaatcactaggtttcttgactatttccagaaaatattttaataaaagacctactaaaatgcagtgaaagttctaaaataagaccctctgaattactcgatgacaaattcattttaaattgatttatacattaataataaaaaaggcttatagccagtctgccttagttggttttaattatattcagaccactgttttgaactgccaaaaagttcctttaagacattatttaacgtatgttcatcactgcaaatcaggtgaattcagtctctctacaaaaatatcctagttacaaataattatttttagttgcacattagcaattagtacttaaatgtgactatgaaatatgagtttgtggcagaacctaaacatatattaccttaaattccaataatccgtcctttgcatactaattatcagccctatactatgaaaagaagccaattgggcctggtgtggggtggctcacacctgtaatcccagcactttgggaggctgaggcaggcggatcatttgaggtcggaatttgagaccagcctgaccaacatgatgaaaccccatctctactaaagtacaaaaatcagctgggcatggtggcaggcacctgtaatcccagctacttgagaggtcaaggcaggatgggcaacagagtgagactccctctcaaaaaaaaaaaaaaaaagaaagaaaagaaaaagaaaagcagcctattttttaaaatacggtagggtacaggtaaaagccatataacgtactctattttagaaactcaaaatataaaaatttggactcacttataaaagattatttccttttgtagtaactcttctaaacatgagggtgtaaacatatcaaagtgatgctacagcaatacaaacaaaactccttctctttttttgtgggggaactgggtcttgctctatcatccaggctggagtgcagtagcacaatctcgactcacggcaacctccacctcccgggttcaagagattctcctgcctcagcctcctgagtagctgggactacaggtgtgcgccaccacacctggctaatttttgtattttttgtagagacagggtttcaccatgttggccaggctggtattgaactcccgacctcaggttgtccgctcaccttggactcccaaagtgttgggattacagatgtgaaccaccatgcccggtcaaaactccctatttcttcagaaaagttaagcctcatgtttaagtcacagtcaactgaaaaggaaccagagttggtgataaagtatttccatgtaacccagtggaaaaaatgttttaatcaaaattcaatttggccaggtgcggtagctcacgcttgtaatcccatcactttggcaggctaaggtgggcggatcacttgaggtcagaagttcaagggcagcctagccaacatggcgaaaccccatctctactaaaaatacaaaacttagccaggcatggtggtgtgcgcctgtagtcccagctactcgggtggctgaggcagaataattgcttgaagccgggaagcggaggttgcagtgagttgagatgacaccactgtactccagccagggtgtcacagcgagactccatctcaaaaagcagaaaaaaaaatttcaatttacagaatttaatccactggtttcagtcagagtttacaactctgcgtttattctacacaaacattctaagaggcaacaacgatagagctgtggccacctttgttacaaagcatgcattcttttgaatatgccacataattatttcattggaaatgcctgaaatacatttttcaacataaattgacttaattgctcttatctcatctgtcttatctcgtttgctttgaaaatagctaaatcggctttaatattacctgaaatggaaaccaatgactccctagccctccattcaaccaaacaaatccaagctcagaaaaacgatcttgggcagatctttcttttactcgactgtggattaatatagagattgggctaattttgaatgtctttaaaacatatttttttctgggcaaatttttaacagtaataggtattctgaattttaaaaaccctaaacacaaagaacgaaatgtaactactacagcacatgtatatataagttgttaggcgcatactgttatagcaatttcagaaagcagggcagagaggttacttgtttctgctgttgagctttccttagtgcctggagtctcttttctttaaggcgttccaattcatcctcatccatctgatccagtttttgaatttcagaatccaaatgttcttccaccagtttggtagtctgaagcagctgatgctccaggactttggaaaacatgtcaacagatgcatcagcttccattcttccaaatggtacagagttcagcctgggtgctggggagaagatttacaaaatacattttaaaaaatgcaaacaataagcaaggttttctctaccattttcaaaaattctggcaagtgtataatgtgtactctatggagtattctaacgacatccaagcacttgatgctgggcttaacaatttttatgtgtttttaaatttaattctcagtaggttctagtcacaccactcaaaaactacttacagcaaatttagggtgcttctgatttagcatatgttttactatactaaagccaagacaagtctttaagaccatcaccaaaccacagagaaatgagttgtgaagttatacctagtgatatatactgacaatcagtgttctttaccaatgggaaagagaaatcagaaacaactgcgaacaataggaaggtatacctactgaggttttacacataaatatatatattaaactttacttaaacacagagtacagttgagcaaaacacagatttttttcatggctgctgcccaaatgagtttcatttaactcctaagacgtctcattaccatttatgtaaagaagagtgcctggtgttccctgagcattaatgtccattcctgttctcccattacctaacaaaaaagtctatgaggtcacaaaaattaatactggtttccatttactgacagtgttaactttgatgtaaaacactccaaatacttttctaaattttgggtttttttccaacatcactcctctgtgtaaaatcagagtttcaaaatagaactaattcagattagaaaggaagacctatctcaattagtcatgcatcacttaacaatgggaatatattctaggctgggtgctatggctcacgcctgtaatcccagcactttgggaggccaaggtgggcagatcacttgagttcagatgtttgagaccagcctgggaaacatgatggaaccctgtctctactaaaaatagaaaaattggccaggcccggtggtgtgtgcctgtagtccccgctactagggaggctgaagtgggaggaggataccttgagcccaggaggcagaggttgcagtgggctgagaacgcaccacttgcaccccaccctgggcaacagagccagaccctgtctcaaaaaccaaaaaccaaaaacccacaaaacaatgagaatacattctgagaaatgcatcattaggtgattttgatattgtttcaaacattatagactatttacacaaacccagatggtacagcctgctacacacctaggctatgccatacagcctattactcctaggctacaaatctgtacagcatgttactgtactgaatactgcagacaactgtaacataatggcatttgtgtatctaaacatagaaaaggtacgataaatacagtattacaatctcataaaactgaaatgtccttatgtggcacatgactatatattttaaaagaaatggagtattttgtactagcaattagtacaaaattttacttttttttttgagacggagtctcgctctgtcgcccaggctggagtgcagtggcgcatctccgctcactgctagctccgcctcctgggttcacgccattctcctgcctcagcctcccgagtagccgggactacaggcgcccgccaccacgcccggctaatttctttttgtatttttagtacagacggggtttcaccgtgttagccaggatggctacgatctcctgacctcgtgatccgcccgcctcggcctcccaaagtgctgagattacaggcgtgagccagccgcgcccggccaaaattttacttcttttaaaagaaatggagtattttgtacgagaaattttataccaacaattagagggcaagtttatgtgtatctcagggttattactgcagaaatgatttataatttgcctatcaaagcaggaggctgttgcatatcaatgaactatgatacatttgcaaataatactgaagcaccccaaacttcacaacaaactgtgaattcattcactcagcttctgacacagattctgacccacacaggccctctataaacgttgagctgaagagaaatattcttgcaaacttcaattctgattcctttttctttacaggaaaaggatttgaaaagcatacttgatttcatctttgtatctccatagaacacagcaggtactcaataaacatgtatttaacgttgaatgaacacgtgcctgacttctgttcaaattactacactgttaagtttcaaaagtatttgagtctaaaaaaccaaattgtaagctcctcgtgagtgctataaaattggaaaggtgctgtatttcaaacacagcaaagatttccacgctccctatcgcccaagaaaaatgtcagtaggactgtgaccctcagtgagggggctggaaggagaagataataagatactgaattgaacgttggaagctgtgctccagggataagcacagagaatgcctaccctggaactttatagaatgagcccagaatttaattatgggataactggaaaaagacgagattaagaagagctattctgggtgtaggtgttggtggtcagagcattgagaatggggtaaagagacgatgcaacccctcgttagcttttcatttttcaaaccacagcctctgattcttcctttttacagctccgctggaagggtgggacgggacacagcgcgtcctcaaattccctagtcatttcctggacacccttacaggtatccgccaaaacaatcaaggggcctggtccttaactgaaccccaggtacctccccaatggcaagccggccactccctgcgcccggggaaacagaggaaagcacagtcccggtggccccaacttcgacgcctcctggtgcgcttgcgcaagagcctctgccaggacaccgacaccggtgctggggccgcgcccctcctccgctccggatgtggagcagcagaatgttcaccagcacccggacgtggtggtcggattcttctcactaccctctgcctcacctgagctctcggtgacgcctgagaagtgaaagagcagcagtttcaaaagacacgtccactccggcttttgccttgcagtagctgccggcggctgcaaacgggccgtcacatccgcctccttattggctgcgaacctcgcgcgatatcaccttggacgccagaggaaggggcgggcggtcgggtggcgaacagttctgcgcgtgcgcctcccgcccagcagcccggaacccaaggtgtccgacccttgctttcctccgggtacacggccgaactggaaggccgcaaagcattgtgggagttgcagtttcttagtgcgcaggctgtcgtggccggactttctcaggagcgtgcttcagtattcacggtccagtgcgccagactggaaatgagacagctgtgctctcgctcagccgtgacgcttgaactgcgtttccattctgttagtgttgaatgaacatttttcttttttttgttttcttttgttaacatttttcctaaagtcgaggcataaacatatacagcacaattaacttttgcatagttaaaacccaaaatatcaccggccagatccagatatagaacattttccaccacccctgtaggtcccctcttgactcttcgaaacacaggaatttttagaactcgccctcgctttgagggtgaagctgaagacctatgttagggaattgatcggctgtgtcctgttctgttttattcagtgactgtacataatgcataatgcatggatgttactgagaggtccctattttgtcctgaatttatctctctcgcaaacccccagaggactctattggttcgttgtggttctttactgaacttcgtgcggctgagaatacaaagatataaagggaagcccaaagcccactcctgaaccgaagcgtgcgttccccgttgggagaggggtgaggtggcgaaattgacagcttcattgtccacctccgggttctagaacgtggaaaacccgcgggtgtcggctcgtggcggacgcttgagggcagggggcgctcgggctgctgcctggtcggccggtcaaccggagacgctctacccgaagcgcagctctcgatgagccgcgccctgcgtcctcacgccgaggcggctgggcgatgcgcttgcgcactgagaactcacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacaggtagataggggttgggtccgtacggcggcggccgccgtggctcagtggagtgtgcgggtctcgccgggcgcggcgtcggaccggggtctgggctcgcgatgagcttcgcggggtaccaggcctgggcccagagtgtgcggagcgggcccaagcccccgggccgggtgggcacgtagggcctcgacggcgggcgggtcctcccagtcgagcctcgctcccccggcaccccttccccggcctgaggagcggggtagtcatttgagggttcctggtcgcgcggggagggtcaggcggcttcgccagcgtggcccaggccagtgtgagtttttttccgcgctactcttggcgagggtggggaagttctttttatgcctcttatacctgtgagtactttgggagggaagggagcttgaatgtgatgtacggccgggtttctctactcgcggtttcaggtacgttagagttatggggaggtgtttagcagttcgctgtctctcaacttaatctgatttggatacagttttcgtttatttaagggctgattgtccagccctcatgcttttcgctttccttcttccggcctgtttttttttgtcgtttctttgctctctagccttcccctaagaaaggaagggaagaagaagaaaccaaccaaccgaggtcgctcctttctaaccacctgcaatgctttggggagggaggataagggtatatgcgagttacttacctagagatttttgagacatttctgtgtgtcacattcgattgagttctgttactcatgatggaaagagttgacttcctgggagtgaacaacatctgttacattacacgttcgtacactacccaccaaacttaaatacgaggcggagagtaaggtaaattaaaaaaactagtgctagttcatcagtctgactcaaaacagatatgttgtcttgaagttaaaataagtttactaattataaattggaagcctggatcgttttctcacctagcgtttgactagcttatgagtagaattaaaagacaacaaagatagtcttgtatttcagttttaggtctattggaggaagttaattggtttggagaattgaattattgttaaaccagatgaatgagaaaataaggattatgggtgatgtaggggaacacaaatttctgtacttttgacaggaatttttgatgtatagggtacttttttccttgctaatgttcagctgtctctagaaaatagagaactgagtataatgagcctttatgtattaattacctgccttcaaccattgttagcacatgacctgcttggtttcatcccacctactagaagtgtgtgtatatatatatatatacaaatatatatacacacatatatataaatatatatatatacaaatatatacacaaatatatatatacattttttttttttttttgagacggagtttccctcttgttgcccagacaacaagaaacttagggcaatggcgcgatctcggctcactgcaacctccacctccctggttcaagcgattctcctgcctcagcctccgagtagctaggattacaggcatgcaccaccacatccggctagttgtgtatttttagtagagacggggttactccatgttggtcaggctggtctcgaactcccgacctcaggtgatccgcccgcctcggcctcccaaagtgctgggattacaggcgtgatccatcgcccctggcccccacctactagatattttaaagcaaatctcattagcttttcatctgtaaatccaccaagtatatctgtaagaaatattaatagtgattcttaaacattagcaaatattcagtcagtttgctgatttccctgattgtcttattacagtttttttttcaattcgttcgtttggtttaggattacacaaatgtgttctttagattaaaattacatatatatgtgtttttgttttgttttgttttttggagatggaggggcagtctcactatgttgcccagtcaggtcttgaactcctggccagtgatcctcccacctcagcctccctagtagctaggactacaggcgcgatccggcttatatgtttccctacttacactttttactttccaggctctttcacaatagaaaaaagccattgggagacaagatgtttattcttgtctgtgtctttttagggaaaagtgagtgtctcattgatttataaagattttcagggatgctgtaaagtttaaattgcacactagaccctgttgttaaatgattggtttggttgtgtagaagaaatgctgttttttccccctctcaacctaatctgtgttttgttgttgttgttgttgttgttttggtttgtttgtttttggctcatgttgaagggaaagtggtggcaatataattttaaaacatttattttctcatataccaatatatgaaattgatacattttgtgagtgtgtgtgtgtataaatgcctcatggactcctttttatgaatggctttcagattgtgtttaagaaatcctgagctttagcagagttccctttgactggaactgcttgggtttttattttggtcttccacatgagatattgggagatggggaatgggaagttccactgctttgtgagtcagctttttacctttattttaatatttctttcctttcttcagggatattttgaatatttgtaaatgggacaaaaacacagactggaaagaaaatctagagggagaaagtccaattttaggattagtattcttgtttgtgtaaaatgagatagagatccggttttattctcctgggtgaaggtccacactttaaagattttactgtcattccacctcccctccttggctatgtcaggcatgtttctggcaaggtgtgaactgtgtgagaaatgacaactgcttatttagttatcaagagaaggcatggagccacttttcagttcttggacagaacatacaatactcactgtccttaattcttatatttaattaatccttattttaacttcttagccactcagtattcatttaaaattagattttaacttacctaattttatttgtacagcatgtgtcagtgatcaagatatttattcttgtctgtgtatttttagaattctagaattttgcttaaagaccaagttctagaattctgttccagtttgtgaaaaatcttcttttttttttttgagatggagtcttgctctgtcaccccgggtggagtacagtggcgcgatctccactcactgcaacctccgcctcctgggctcaagcgattctcctgcctcagcctctcaagtagctgggatgacaggcgcccaacacctggctaatttttgtgtttttagtagggacagggtttcaccatgttggctgcctggtttcaaactcctgaactcaagtgatcctcccaccctggcctcccaaaggcctggaattacaggtgtgattcaccacgctcagccccagtttgtgtaattctaagaatgagattttgatgtggtgtttgttcagcaagttttcctgacctttttcagttgactcgggaaacttgttgagacaaaggctaggattcaatatccacatatcaaacaaatataatacacatagcctaggtttaataaaggaattcatttcttacttgcatatatttgaatgaaactcttgtctgcataaattacatcaaaaaaagatgcataatcagaattcttttggtctagcctgttcctatcctgacgctttaggaagtggtaggggaagaagtcctagtttgctataaattaataagaaaacagattatagatttttgttgatagtaacctctctagccttccatgctgtccctgtggggaactcattcagctacttttaatgttacttgctcatttgttgtgctttatttatgcttctaagtttattccagtattgcagttgatctataaggtgggcagagtgttgttttaccaaggaactgagtgtcagtggttaggttagaatagcaattctcaaattctggtcctagactcctttacactcttaaattcctaaggaacacaaaaggcttctgtgtatgtaggttatatctaccagttacaggtattacaaactaaaactgaaaagttcttcaaatatttaatttaaaaataaaaataaacttacactatgatacataacattattaaataaccatattttcaaaaatagaagagctaagcgtttttgcaaacatcttcactattatatgacttaatagaagatagatcctcacatttgcttatgcatttgatctgcagcatcatcacacatcatttagcttctgaaaaactcccctgtacagttgtgagaaaatgagaatgaaaaaggctagtatcctcttagtattattttgaaaatagttttgaccccctaaaatagtttagattccctaaagagaccttgggaatgaatttgaggactgctggcctagggatttctaaactagatttaggcatttgtgagacatttctcaagctgtttgaccatcgttcatgtatgtcttacaggtgctgagaatgcttgagaatcacttaaaggcaactgaagacatctgtgggcatgttaatgttcttgatattttaacaatttgagatttttcctttttttttttaaatgtaatacttgccaaggtaaatatcagttgagattgatttcaattgggagtccattaagtttatagattatttgtgacacttgacatctttatggtgttgaatcattccattcaagaaatatattgagatttaagcacttgagtgccagatatttttctggatgctagaaatatatttgtgaacaaataagtaatatgatttgcctctccatttagttggttaatttaattctataacagtaaaatattattttcttcattttaatctttaggatttggctttttcccatgtatcacagaatttttgttgctgttaatgtaatcattcctccccctcctttttttttggtaaattgtaaaattttgtcttttttgtctccttttctccttcctttctgttgagagatggaatctcactctgtcacccaggctagagtgcaatggtgtgatcatcgctccctgtaaccttgaactcatggactcaagcagtcctccctcctcagcctccccagtagctaggactgcaggcatacaccactgtactcagctaatttttaaaaattttttgtagagatggggtctcgctttgttacctaggctggtcttcagctcctggcctcaagtgatcctcccatctcagcctctcaaagtgttgggattacaggtgtgagccactgtgcctggcctgggttgtctttttctttctttctttctttctttcttttttttttgagaccgggtcttactctgttggccaggctggagtgcagtggcgtgatattggctcactgcaacctctgcctcctggattcaagcgattctcatgcctcagcctcccaagtggctgggactacagtgccaccatgcccagctaatttttgtatttttagtagagatgcggtttcaccatgttggccaggctggtctcgaaatcctcacctcaggtgatccatccgtcttggcttcccaaagtgctgggatcataggtgtgagccaccgcacccagcctgggttgtatttttattgttgggttgtaagaggtcttgatatagtctggatactagatccttatcagatatatgatttgcagatactttctctgatttctgtagtttgttttttccactgtcttttaaagtttctttttcacaaaagttttaaattttgttgaagtccagtttatttttgttgttgttgcttgcattttggtgttgtatctgagataatctgttgccaaatccagggtcgtgaagatttacctgtatgttttcttaagagttttattgctggccgggcacagtggctcatgcctgtaatcccagcactttgggaggccgaggtgggtggatcacctgaggtcaggagttcgagaccagcctggccaacatggcaaaacctactactaaaaatacaaaaattagtcgggtgtggtagcacgcgcctgtagtcccagctactcgggaggctgaggcaggagaattgcttgaacctggaaggcggaggttgcagtgagccaagattgcaccactgcacgtcagcctgggtgacagagtgagactccatctctaaaaataaaaaaaaaacaaaacttttattgccttatctcttgcattttggtctttgttccagtttgaattaattgttgtatgtggtatgatgtaggggttcatctgcattctttttttttttgagacggagtctcgctctgtcgcctaggctggagtgcagtggcgcaatctcagctcactgcaagctccgcctcccgggttcatgccattctcctgcctcagcctcccgagtagctgggaccacaggcacctgctaccacgcctggctagtttttttgtatttttagtagagacggggtttcaccatgttagccaggatgggtctcgatctcctgacctcgttatccgcccgcctcggcctcctgaagtgctgggattataggcgtgagccaccgcacccggcctgcattcttttatatgtggatatctagttgtcctaataccatttgttgaagagaagatttctttccctattgaaaggttctggcacccttgtcagatcattagatgctagatatatggatttatttccggactttaagttttatttctttggtctgtatgtctgtgtcagtgttgccaccacagtttgttgttgttgttgttgttgttgttgttgtttctgggttttttttttttgagacgaagtctcactctgtcacccaggctggagtacagtggtgtgatctctgctcactgcaacctccgtctcctgggttcaagggattcttctgcctcagcctccggagtagctgggattttaggtgtgcgccaccaggcccggctaatatttgtgtttctagtagagacagggtctcaccatgttggccaggctggtctcaaactcttgacttcaaatgatccacctgcttcagcttcccaaagtactgggattatagatgtgagccactgcatccagccggcaccacagttttgattactgtggtgtgaatttccttagatgaaaaatttcaaacacatacaaaagtagaatagtctaatgaacaaacatgtgtccatcacccaggttcaaattcattcataaatctcatttcatatgtattctgccccctcctttcttttctccattatcttgatacaacctcagacatttgtaaatatttcaagaaattatataatgtattataagaaacatttatatcttaaatataaatttttagaagtggtacatttcattcatttggaaaattcacatacaatggaatcgttgtctgtgttgtcagataaatgaaatgtcattgtactttttcagaggcatttaaactagcgtttcaatttattgcttcagaaaattccatttggaagttttatgatcaaaagtacagtaattattatagtgttagacgtgttttttattaaactgctgtgttgaaactggttagccttgcctgttgtatgagagtcgtgattgccactccagaataggactttttccttatttattagtgcctatttgaaatgtctaacatgcgaccgggcatggtggtggctcgtgcctgtaattgcagaactttgggaggccatggcgggtggatcagttgagcgtaggagttggagaccagcctggccaacatagcaaaaccccgtctctactaaaaatacaaaaaattagccaggtgtggtggtgcatgcctataatcccagctacttgggaggctgaggcataagaattgcttgaacccgggaggtggaggttgcagtgagccaggattgcaccactgcgctccagcctgggcaatggagtgagactgtctcaaaaaaaaaaaaaaaaaaaaggaatgtctaacatgcctttctggttgccacttgtagaacataggtaggtgggcggggtgcggtggctcatgtctgtaatcccagcactttgggaggctgaagcagaaggattgcttgaggccaggagtttaagaccagcccgtgcaacgtggggagaccccatctctaccccctaaaaaaaatagctgagtgtggtggtgtgtgcgtgtggtctcagctactcaggaggctgaggtgggaggattgctggagccttgggaggtcaaggctgcagtgagccatgtttgtgccactgcacttcagcctgggtgacagagctagaccctgtctcaaaaaaaaaaaaaaaatgtggtgaattgggaatacaaaagggagtttgctgttctcaaagggagttacgttttaacatagcaaataggcatatgcacagataatacagagtgaagtgctgaagggagaaaatggagtatgagagtaccaccctcgagatttcacatttgcctcttaaagttattgtttatgcatctttaaaatccttttctaattaagtttgccatcaagagagcgtgcagattggaaggaatgggagtatgctgtgtgtttctgtgtctctagagtaccaagggtgaccatgaggaatatttgagatcttcagttgctcctgtattgccaataattttgtacacaggtgcagccagaccattctaatgatggtgttcaccaaattggttattcagaaatctggtcttgagagtggttgtctacataaaactttttgttaaaatttattagtaattattagtttgttaatattaatgatttattaatattagagtgccaggcactatacaagttaggtggggaaaatcctttaacagtgattaaggatcagagttaacttctatggagtacagagactgagtttgctttgagcacttaccatgtgattagttattttagaacataagttgtatctctttttttttttttttttttttttttttgagaaggtgtctcaagcaatctcagctcactgcaagctccacctcccgggttgatgccattctcctgcctcagcctctcgagtagctggcactacaggcacccgccaccacgcccagataattttttgtatttttagtagagacggggtttcatcgcgttagccaggatggtctcaatctcctgaccttgtgatccacccgcctcggcctcccaaagtgctgggattacaggtgtgagccactgcgcctggcccatataagttgtatcttaaggtgtttattgagaatgtggatctgaatttttatcaatattatatatatctgcagacataatcctaaatataaacttgtatctctgtaattatgaaacccaaaatattctttttttattattattttattttattgagacagaatcccaccctgtcgcccaggctggagtgcagtggtctgatcatagctcagtgcagccttgatctcctgggcttaagtgaccctcccacctcagcctcctgagtatctgggactacagacgcatgccaccacacccagctaatttttttgatttttagtagagatgaggtcttggtttattgcccaggctggttttgaactcctgaactcaagtgatgttcctgccttggcctcccaaagtgttgggattacaggcatgagccactgtgccaggcccccaaatagtcttatatcaaatagtaacaaatataaaattttgtaaagttccaatctgcagtattgatttgaaagatgatgccacgttgttgaatctaaatcagggcttctcaaactttgttcacctggggatcttgttagaatggagattttgattcagtagatctggggtgagggtctgagattctgcatttttcagttttttttttttttaacaggcctgagattttgcattttcaataaggtgatgatactgatgctgcttgtcctataactatactttgagtagtaggatctaaatgaccattttcattgtgaatgtattgcctcttacaatggatttcttttgagttcagcatgcctgaactagcaagagctcaattcttctgatacttttttttttatttgaactagtgattttgagctttacatgacagattcttctcttgacaaaaaggtttaatttacctagtaagtgtgcatctgatctttttcatcaaccggaaacaattttggggggtaggggttgtaaacaaaaccttgggttgctgttctatgacagtatactgtgataaagtggctgtctgtattcatcttaaatctttattatcaaattaaaatttaaaacaggtaaaacagaagttgctagagaattttgaagcttctgaaatccctgcaactctgtgttcctccccacttaatccagtttgtaaaagctgtactgatctgatagttagacatactggaatctataatacatatgaacttagggtatgtgtatcgggggcgtctacaagatttgtattcttatcaaattaatgtatcagatatttagaaaataaagggttaggctgaattttgtagaaggtgataagatacacataccctttgcattgcattgtataatatagtagcagtatggtttcatatcccttttaaaggagtcacgacttcataaggacatcgtaagctgggagggttttcttttgagacatagctagttctcagcttattgattgtagtacttgagccataacttcattaagagagttgagagtgaaaactgttaagatttgtggttataagtggtgggggccactgaggagcaatgactgctgggctttcccttcttttgtcttgtttttcctctttttgtatgtaactgttgatgatcaaagatgttctgggtaagaagatgaagactggggaaatgagatgtcagaaggtaacctgtagagaaggtgggactgaatttcccggtttctcttattgcagctgttactgctgagatagagttaagaataaagagaaggattccctcttatgctcttcttgtttactattattaagagttttggcggagaggggcagaagccaaagtaagtgaaaaagggcagcaacagtgttatatgtgacttatccttcctttaatactttgaggttttggacaatttgtccatcaacttggggatggggacggaggaaggagtggtgtagtttggattttacacttctaccaacatgctgtccattactataggtcctggtattgattaggaataggaagaaatatgggggtgcttcggttattattgtaccataacaagtcatcccaaacagtggcttaaaacaagaaaacttgtgattatctttcatggttctggaggttgactgggcttaatcagctggagttgtcagctggagcatctctatttgatctctcctcctgacctggacatccccattagcttggcagtgagcattccaagagacaggaagctgccaggttaaggcctaggcctagaaactataacaaaagttgcatccttctatttagcaagcagtcatacaactcccacattaaaggagatagacctccacctctcaaagagtgtcagagatattttgtgccaggttttaaaacctctgcagtgggtaaagaggcattggagaagagaggttggtaaaaaggagtcttagacatcttggagattttgaagtgtggaataatttggaaaggagttgaatttcctgtgtttcttgtctaactttacattcattacacaagttttcagtggaaaatacctgtcattatcaaatgaaatttgctaagtttggaattgagaggagatttgtacatgaggttaattttccttttactttgcagtgaacaattttttgtaatatgtgtctttaaaaggctttctactacattggtctcaagatgaagtatttgtcttactttttatttttatgtatgatttttatttaattccaaaagccaaactccaaagttgagtacatgcctgcacacacaataaagaaatactgtttttatacaactggaaaaatacaagttgtattttgttcttgacacataataattgtacatatttatagggtacaatgtgatattttggtatctgtatacattgtgtaatgatcagatcaggatgattagcatatctatcacgtcaaacacttgtcatttctttgtgataagaacattccaaatgctcttttctagctgtttgaagtataatacattattgttaactatagtcatcctactgtgaagtagaacaccagaacttattctcctaactgtaacttgaccaacctctcctcattccctctccttcctactcttcccagcatctggtaaccactattctactctttacttttatgaaatcaactttttttgattccacatatgaatgagatcatgcagtatttgtctttccatatatggcatctttcacttaacataattacatccaagttcatatgtgttgtcacaaaatgacaggatttcattcttttttatggatgaatagtattcacactgtgtagacgtacattttctttatccattcatctgttgatggacatttaggttgactgcacatcttggctattgtaaacagtgctgcagtaaatgtgggagtgtaaatattcttcaacatagcaatttcatttcctttggctatatagacccaatggtggaattgttagattatatgatagttctgtttttttgaggaacttctatactgttgtctctaatggctgtactaatttacatttccccccacagtatataatagttctcctttctccatattctcaccatattattttttgtctttttgtaaaagctagtctaaggtgtgatatctcattgtggttttgatttgcatttccctgatgtttttttcatatacctggtgcccatttttatgtcttcctttgagaaatgtgtattctgatcttttgcccattgtttagttggattatttgcttttttgctattgttgttttgagttccatatgtattctggatattaaccccttgttagatatatagtttgtgaatattttctcccgttctataggctgtctcttcactctgttggttgtttcctttattgtatttgtcggtttatgcttttgttgcttgagcttttgaggtcttaaacaacgttatgaagtgtctctcctgttttcttctaatagtttcatagttttggattttacatttaagtagttcattttgagttgatttttgttaagtggtgagatgagaatgaagaaataaagaataaaatgtttttaaaagactccttcattaagtatcattttaactccacattactgtgtttaatagaaattaagatactagaaaaagattatagatttgttcttatttttgtaacttataaaaatggataaaagggccaggcatggtggctcaccactgtaatcccagcactttgggaggccaaggcaggtggatcacttgagcccagtagtcactgtagttttcatgttttatttttggtcactgtagttttgccttttctagaaattcatataagtagaatgatagactacatagtcctttttggctgactgggtttcacttagtacagtatacttttgagattcatctatgttagtgcttgtagcattagtacttcccttttgttacccagtagtattattccattgcctggatatatgacaatctgtttatatattatctggtagatggatatttgggttgtttccagcttttcctgatttcgagtaaagctgcaatgaacatttgagtataagtctttgtgtggacatgtattttcatttctcttaggtaaatacctaggagtgggattaggagtgggattgctgggtcgtatggtaagtgtatatttaacaagaagctgtcaaactctcttccaaagtgactgtgccatttttgcattccctctagggatgtatgtgctccagttactccatatccagtctcaacacttggtattattaccaatcttcaattttaggatttctagtggctgtgtagtgacatatcattgtgttttttttttgtttgtttgtttgtttttgagacgaagtctcactctgttacccaggctggagtgcagtggcgtgatcttggctcactgcaacctttgtttcccaggttcaagcaattctcttgcctcagcctcctgagtacctaggattacaggcacgagccaccatgcccagctactttttttgtatttttagtagggacgggatttcaccttgttggccaggctggtcttgaactcctgacctcatgtgatctgcccacctcggcctcccaaagtgttggaattacaggtgtgagccaccacaccctgcctttattgtagttttaatttatgcttccttattagtgataacatcttgtcatgtgtttgtcattctttcatctcattggttatgtgtctgttcaatcattttcccatttaaaaaattgtgttgtttctttgtaggcaaatcctttatgagatatatgtattgcatatattttctctcactctttgtcatggcttttcttttcttcattttttttgagacagagtttcgctcttgttgctcaggctggagtgcaatggtatgatctcagcttactgcaacctccgcctcctgggttcaagcaattctcctgcctcagcctcctcagtagctgggattacaggcatgcgccaccatgcctggctaattttgtatttttagtagagatggagttttgccatgttggtcaggctggtatccaactcccaacctcaggtgatccacccgctttggcttcccaaagtgctgggattacaggtgtgagccaccgtgcccagcctgtcttgccttttcattttgctaattgtgtcttttttttttttttttgacagagttttgctctgttgctcaggctggagcacagtgatgcttgtgccttagcttcctgagtagctgggattacaggcatgtgccaccgtgcctggctaattttttttctattttttagtagaaacaggatttcaccatattggccaggatggtctcaaactcctggcctcaagtgatccacccacctcccaaagcgctaagattacaggcgtgagctactgtgcctggcctattttgttaacagtgtcttttttaaagttaaacttttatttcaagattattatagattcatatagttgagacagggtctcactctgtcgttcaagttggagtgcagtggcacaatcatggctcatcatagcctccctctcctgggctgtcaatcctctcaccctagccattggagtagctgaaagtacaggcacatgccactatgcctggctaattttttcttcttcttctttttttttttttttttttttttttttgagacggagtctcactctgttgcccaggctggagtgcagtggcatgatctcagctcactgcatcctccacctcctgggttcaagcaattcttctgcctcagcctcctgagtagctgggactacaggcacacaccactacacctggctaatttttgtatttttagtaaagacggggtttcaccatattggccaggctggtctcaaactcctgaccttgtgatccgccagcctcggcctcccaaagtgctgggattacaggcgtgagcccccgcgtctggcctgcctggctaatttctttgtagtttttgtagagtcagggtttcgccatgttgcccagtatgatctagaactcctgggctcaagcaatccacccacctcggcttcccaaagtgctgggattacaggcgtgagccactgtgcccagccattacacagataatgacattgatacaatccactgattatattcaggtttgccgagtttcatttgtactctttgtgtttgtgtgtgtgtttatatatttagttctgtacaatattattacatgtgtaggtctgtatatccattacacagtcaagatgcagaatatcagtgcaaaaatctctcatgttgtacatttgtaaccatctccttcctgtactccctacccacctccccaacccctcacctgtctctaacctcaggtgtcttgtatgtttctaaacttttgtctttcaaaaatgttgtattaatggaattaagtatatatatgaccttttgaggttggcttctttctactcagcctaattctcttgggatctatcgaagttgttgcatgtatcaatggttcattccattttattgatgaataatatttcatggaatggaaatgaaccactgtctattcaaccattcacctattaaaggacatgtgggttgtttccagtttttggctattgaaaataaaattgctatgaacttctgtctacagatttctccatgaacataaatttttgttatttaggtataaatgtgcaagaatgcagttgctgggttatgtggtaagtacatttttagttttgcaagaaactgatagactgttttccagagtggcattgccattttatatttctaccagcagtgtatgaattttccagttcctttctatccttaccagtattggttattatcactattatgggggaggagggcattctcattggtatgtagtgattcgtatgtagtgatatcccattgtggttttaatttgcatttcccaaatagctaatgatgtgaacatttatttgccatgtgtatatcttcagtggaatgtctttttatgccttttgcccattttttaattggattgtttggatttattttactgttgagttttgagagttttgggtatattctagttgttaatccttgtgatttggaaatattttttcccattttgtagcttgttcttcattcccttcacatagtctttcacagcaaaagtttttgatgagttccacttcttttggattgtgcttttagtttcaagtcttaactcttaactctttgcttagtgctagatctgaaagatattttactcttttcctaaaagtttatgcttttatttatttttttaagtacatcatatatcttgggttcactcttggataaggactgagggtgaggttcatttttgtgtgataggtgtccatttgctgtagcactgtttgttaaagaggctaccctctgcttttgcacctttgtcaaaaattaattggttgtacttttttttttttttttttttttttgagacagtgtttccgtctgtcacccaggccgtagtgcagtggtgctatctcagctcactgcaacttctgcctcctgggttcaagagattctcctgcttcagcctcctgagtagctgggattacaggcacctgccgccacacccagctactttttgtattttttagtagagacggagttttaccatgttggccaggccagtcttgaactctgacctcaagtgatccacctgcctcggcctcccaaagtgttgggattacaggcgtgagtcactgcgcctgggcctaaatggttatacttctgtgggactgtttttgggttctctctcttctcgtcttgatctgtgtctattcctttgccagtaccaagagctttgcttaagtcttgaaatctggtagtatgattcctcacattttagtcttttttcaaaattggtttagctattctagtttctttgccttttcatataaatattagaataaccttgtctctattggttatgtcctaaaaatcttgctgagatttttattggaattgcattaaacctgtatatcattttagggctgattgtcatctttactgtgttgagtcttatagcccatgaacatggcatgtctcttcacgtagtcaagtcttggatttctttcataagcattttgtaattttccacatataagtactttacatattttgttagatttaagtatgttactttctttggaataactataagtaatatgattgttttttccccctcagtttttctgtttgtttgtttttttgttttttgggttttttttttttttttttttgagacagagtctcattctgtcgcccaggctggagtgcagtggtgtgacctcagctctctgcaacctccgtctcccaggttcaagcaattctcctgccccagtctcccgagtagctgggattacaggcatgtgccaccacgtccagctaatttttgtatttttagtagagacagggtttcaccatgttggccaggctggtctcgaacttctgacctcagatgatccacttgcctgggcgttccaaagtgctgggattacaggcgtgaggcactgcacccggcctccctgctcagtttttaaaaaataaactttaatttgtagaagttttagattgtgaagataatacagagtctccatgtgccccacacctagtttcttctgttattactatattagcatggtacacttgtttcagtcaacgaatcaatattattaagcgaagtgcatactttgtgtagatttctttagtttttctctactgtcctgtatctgttccagggtcctatacaggataccacattacatttagtcagcatttatccttagatttgtcttatctgtgatagtttctcagatttcattatatcactgatgtcgatgttgatcacttggctgaggctgtgtttgtcagatttctacattataatgttactcttttcttcctctttctatattgtactctttggaatgaaatcactgtacacagctcatagtttaggagtggaaaattatgttccacctccttgaggatgggattctgcatatttagctttcttctgcacacgtttgtctcttccccatttatttacttaatcatttctctctaatagtatgactagtggaattatttcatactttagcttataatttaatattgttacttaatttgttcttctaattaattaacatattaatttgttgctcccattgcccattgggagctctttcagttggctcatgtgtccctttgtcatagactcaacattgtgtgtgtgtgttttcgtgtgttttggcattttcttgtttgtgtgtttgttttttgtttttaaatcatttccttacttcctaccattacacagtgctccaggcttgttttgtctgtgtccagcccctgccccagaatcagccattttgctttcttaccaggaattggtattgtcagtttcttggattttagcaactctgataggtatataccactatctctttgttttaatttgcatttccccagtgacaaatgatgatgaacatttttcatctactccccctgcccctaatttgacaaggtgactgcccacattttaattgggttgttattgttgagttttaagagttctctgtgtatttgggatacaggtctttcagctagtagtgctttgcaaatatctctttcagtctgtggttagtgttttcattttaatactagtatcctcagagctctatttctgggctgcctggtctgttgccttgatctgtgtgtctcttctttcaccagtactacactgtcttgatagtaattttataataaatcttaaaattgagtaatgaggcttgcagctttgttcttcagtattatgttgacttatgctaagtcttttgcctttctgtgtaaactgtaggaatttcatagctatgtttgaatttttcaagcaagtaaaaaactagatcatttcccattttctaggaaggcagtagaacctggtgttaaaatttgggcttgaattcctggtatgctactttgtagctggtggcctttaaaaaattaccatctttaagaataattttatgtaattgttatgaatattaagtgacagtgtatatattatgtctaggcattggtcagcacaatgcctgaatataagcatattaaaaaactgttcatcttatattgttagtcacaaaaagcctttcagacttaataatgtacaaatgtagtcctatactttgttatcctagagatgtttattgatgaattctccagaaatatagctaatcacaagaagattcttgaagctattttgatgaggtgaatatagtttgggtgagggccgataaatttttggaaatgagatgccaaacttcagccttctcttctcatgcagttgtcagaagctgctgtagtgtgaaatgttgccagagatgcctttggggatactcctgggagatgctagggcagacttaggttcttgttacctgaagagacctgagaattgtccttgattcttccttactcctttctatattcatcctgttgaccacttaagtgttgttgattctattcccttaatatttatctaactcatttacatcttgcctgccactggtgcaagtcaggtgctcattgtttctcattacagttactacaaaagcttcctaactggtctccttgcttcctgactagtcaggattcagccctgccactcattgtaccagatgtagcattctaaaatgcttttatatatatatatacagggttttactcagtggcacaattctagcttactgcagcctcaacctcctgggctcaggtgattcaggtaatcttcccaccatagccttccaagtagctgggacaagaggcatgcgccaccatgcctggctaatttttttatattttttagagacggggtttcatagtgttggccaggcaggtctcgaactcctgggctcaagtgatctgcctgcctcagcctcccaaagcgctgggattacaggtgtgagacactgcatccaggcctaaaatacaaattggattatgtcagcagaagtaagacatctggctatggaatcagacttcctggattcaaatcccatatctccgactcgtgtgatcctgggcagattctctgtgcctcagttagtagttacttcatctgtaaaggaagaagaatgacagtgttcagatctggtacacaatcacctggaaatattgttgctaaaaatatactgcctggcttccccctcagtttctggttccctctatcttgggtggggtcaataaatacataatgctcaaacatttcttgggtggttcagatgccttttgtgagccctcttgaggcataacacaccttgttgcctttaggcttttgtacttactgtgtctggtatgtgtaccccttttactaagaataaggtgcctctgactttcccattctggatttggtactgtaggaagtcaccaccactgcagcagatcagtgtcaaattatctaaaatgtaggaagaaaaggagcacatttcaattctggccaactatttataaaagcattaagttcttttacttcaaggcatttaacattttgcaatttggggtttactggtttgctgtcttccctattaagcgccttaaggctaaattctatatcctcaatgtcttgtcatataatcttttaattatatttataatatggttgaaagttacttctctttagaaattttctttactgagaccgggagcagtggctcacgcctgtaatcccagcactttgggaggccgagggtggctgatcacaaggtcaggagtttgagaccagcctggccaatatggtgaaaccccgtctctacttaaaatacaaaaaaaaaaaaatgaaccgggcatggtggcgggctcctgtagtcccagctactcgggaggctgaggcaggagaatcgcttgaacccaggaggtggaggttgcagtgagccgagatcacgccactgcactccagcctaggcgacagagtgagagtccgtctcaaaaaaaggaaaaaaaaaaagaaattttctttactgaactaaagcatctcttacaaggtgtccattataaaggccacattacatgagttgttttcttactgtgccattcatttggattcatctgcctttgctacttggacattttagactggactgccttcattttctgtaggttttagctggaacttaatttggtttactccaagtaagttggtaggtgacgacattgttggatggatccagaaatgaaaccaggagcaagcaggtttagttctggatttttggttaagtattttatttagtgaatcattcctaattcatttagatttgaatgtgtggttatgtttttctcaggacattcaatccttgtgcattttagttttcccattggtaaaatgagataataggctaggtgactgatctctaaacttccttccaactctgaaatttctgctattccaagtaaaaatgcacagggatccaaatatttaggtgttgttattgatcgtcgagaaataagacttgttttatgttttaagatctcccattttataaataacttcattcagacgcacaaaaaacctttggtatctgtaaaagttaatttccttttcttgattaccctgatttttttctggagcttttcattatctgttccttatttgagtgtaatccagaaacttcactgaagcagatgtagggaggctgataagtagatgtaacttgtgttgtaatgaaagaacttgccaaatgatttttctcattgtgctgctaatgcatgaaaaaggttaaaatgataaaatctatataaatgaatgattattttgcttttaagtagcatttaggatgtttttgttttcatttaagcaccaaggatgacattgatcttgatgccttggctgcagaaatagaaggagctggtgctgccaaagaacaggagcctcaaaagtcaaaagggaaaaagaaaaaagagaaaaaaaagcaggactttgagtaagtatattttaaatatatttgatttttatttgttttggtactggattcacttaataaaaactataccagtgcttcacaatgtattttaatccttttctagtgaagatgatatcctgaaagaactggaagaattgtctttggaagctcaaggcatcaaagctgacagagaaactgttgcagtgaaggtgaaagacagacctttgttacctattcgtatttcgtattctattctttcttcttaatgttggtttggggagctacatttggaaacttttgagcagtgtacaatatgttatttaaaagcttctatgaaatctgatgtcaaagggaaaaataggaatgtaaaggtattttgtggtatgttgattgttcataaaattggtacatttggagttgtgatgtaatcactcgttccatcttcagttttctctgttgtttctttttcatccttcgaatttggataagcctcagagtaatgggaaaatcatagatattttttcttctttcaacttgtcccttaggctttgtaaagttagtaaatgggtggtgactagtgcctgtttcaagagcccctggattctgcaatttacaatgatgcgagatgtgtctgaggccaaggccaacctctcttgcttgtttgaattttatattcctgtgaaaaagactttgaaaaagattttgaaatcattttgagatttttaaaaaatgtttacttaatgaagcacatgactctggtctcaattataattctgttaattttttctaacaatggaaattttttagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaaggttggttaatactttagaggaaagagcaaaaggcttttgattcacagtataagttgtaatcattgtgccccaaggtcgttttgttatttgtccatgggtataaagacacttgattgtaaggagccatctaaaaaattacgtctaagtatttgacttgatttgcattgttaattctttacatatatagtataaatatctttcagattatttatgtacagactggaatttttatagaattgcattatgaaaactattttttttgctgttgataaaggctatagaagttacttaatgaaaaatttattcttcctttctgataactcagtgtcagataatatttgaattctttcctgtctttaaaaacctagttcaatttatgaaattcacaaagaaatgttttcatgaagttgctaatattttctgcttcacttaaaactcaacatgctaaaattagtgtcttttaagcaataatgagccatttttttaacaaccaattataaaataaaagttctagctaatttcttcctcttatttagaatgaaaatagctaaagatcagatggtttgcatggccatactatattcttaaaacagtagtttttgggctgggcgcggtggttcacgcctataatcccagcactttgggaggctgaggcagatcacgaggtcaggagatatagaccatcctggctaacatggtgaaaccccatctctactaaaaatacaataattagccgggcatggtggcgggcgcctgtagtcccagctactcgggaggctgaggcaggagaatggcgtgaacccaggaggcggagcttgcagtgagcggagatcgcaccactgcactccagcctgggcaacagactgagactctgtctcaaaaaaccaacaaaagcagtagtttttcttttgactggaaaacttttaatgggaaaattgacacaacttttttttttgagacggaatttcactcttgttgcctaggctggagtgcaatgacacgatctcagctcactgcaacctcctctttacaggttcgagtgattctcctgtctcagcctcccaagtagctgggattacaggagcccgccaccatgcccggctaatttttgtatttttagtagagatggggtttcgtcatgttcgccaggctggtctcgaactcctgacctcaggtgatccatgcacctcagcctcccaaagtgttgggattacaggtgtgagccaccgtgcccagcaacttttttaaatgctagcatatttattatctggatatattcgaggaggaacaccatgaaagtaccttcatagcttttaattctttagagttcttggagtataactacctatatttttgtattttatcctactaataccccctaaagtggacatcattctcattaactccatcttgtagaagtgaaattagctacagaacttacgtgggtgttagttcattctgattgttagaacttcatataagcatctgttggacaccagccactcaggtaccatggatttagagatacattaggtacaggattgcccttttgctgctgacagtatccttctgtcttactgtattcctcaggacatctgagaccaacatcagtattgcagacttctcaggaggccatctgtgagttattctgagctattctagttaccaaagtgctcaggatgccttgatgcctgtagaacttagcctgctgctggcatcggccttggcccattatggtccttgaattgtggttgggttttgctcgtcatcaccacagggaattgttttttcatttcaatgctttgcctttattctttttggtagatgacaatgaaggagacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggtatgttttcatgaagttggtaacattgatattgtgtttaacttaaaatctattctctgtaaaatatctttactcttctaattctgaaaatttcatagttgcatggtaattcagttatattattgttccgatacaaataataagatgaagaggtacagcacatcttatctttattttctcaagaacagattgctcgatacataagttgcttatgtatcattgccaataatctgatgtgatattaattaataatcatgtataacatttaaaatactttgatttggaatctcctaacataatactttgcatgtgtctcaagagatttatttgaagtttggattgtttacatttgaattttatagttcattaaatgaatacaggttttgtctgacatgtactcttttataggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgagtggtactcttcattaactgaatggtcagagagctctgcacatgcagttatatcccttaatgttcagaaggagaatggaatttgcatcaggacagttcctatgaaaaatctgtgaaaaagttcagtaaaacgtaaggaataggtgatgtcatttcattgtttaggaagatgacatctacatgaggataaaaatttatatgtaaatgatagtatgtctaaataagttatcctcccacaaacaagaatagtgataataatagaatgagtccctgtgtacctatcagccagcttcaacaattaggaccatttgacattcttgttttgtacctctccatctactttttatcctagcatgttttaaagtgaatcccaaaaaataaaaaagaaatacagtgattcccagacagcatattagtttgcccacatgaccacggtgaaaaagtattcatgaccatttttttttaaccctttccttactttctgatgcaacaagatatcccaggttcatcttgcatgggctgagacctggaatcggttgtttatccaaagagcttttgttccttttagagggtaatagtgtttagagatcacaactgggcatataatttattacttttttgaaaggtaaggtgatttaaaatagtgtctttgctccaatgagaagaatatattgggacctctcttaaatttcctgctcctatattccctagatttttatattacagtcattttggtgtttatgctataattacagtaatagctaccatttattgtgtgcttagtgtgtaactgatgctacaatgtctttgacattgtctatttttccctcataaaaaaatcttatagctatttttacttccatcatatagatgaagaaatggtggttcagagtgtaaacagcttacccaaggccacagagctgaaatttaagctggtctgtgcaactttttcttacgcatatgttcagctaggaacattagatgtgaagaaacccagtacttagattttagaaagttttattcttaatggagaatatagcttttgtaaaattttaaatgaaattaggtacaaacttgaatatagttagcattcatacatcagatttcattggtgactattggagaggctaaaagcacccatgaagaaattcagatgggaccaagcagggagtaatttgccagtctcaaaaatgctgttttaaggagcagttagacttgtagttatggaaattacagtgtagaatggtggacttttagcatcagtctttagcattaggcttgtaagagatgctctctcaagtggcatccctgacgctggtctcttactcttcatagtgttgtccagtgtttaccatcttattagttccctattgtctactaataagaatccaaattccttagcttgacattcaaggttcccccccacccacagcccactcatgtgagtcatctcattaaaagatcctacagtgttgtttcatcgtatgtttgaaagacagctgcttaccacatttattacctagaatattgtaaaacttattcattgagctaaaaatgtactctcagagagtgtaggcatctgcaggtgtcttcatataattgctctgaaatgtgcagcaggttaacttttcagtcatcctttagcctgtgactactaagcatatacacacacacacatatatgagtactttatcaataatttgtaataaactcatttcaggcaaagagcttcttcaagaacttgattgttatgtctcagtttgcaaagtgaatggaatgtctaaacacatacaagtcttggtgttgattccaagtacagcagcttatttgagagtctgagactagagcagtagtcagttgattaagtctagggtgttattgggaccacccttcaggtaatccagcctacagtttcccctcaggcccatgcttttcatcttagtaggtgtaggctgctaggcaaggaaaacttaaagtgatgatctctgcattctcagctggctttatcctctttctttggtttgtttaatgtattcgtcttaccagtcatagctatggttttaccattctagccattcttcagtacatgcacaacacacatccatatacattcctacgttagagataacatttttagtcattttcctttattagtgacttcattcaaaatcccatggtatacaatttctgttgtctttattctaaggcttctgcccatagtgagagactgagtcagtaatccagtaatctgtagattcagttcaatcccagtcaaaatcacagcatggtattttgtagctatctgtcaactagttctaaaatggatatgaagagaccagagagttagaatggccaaaatatgtttgaaaaaggagaacaaacttagaatacctgatttcaagacttagtataaagctataggaattaatacagtgtgatattgccagaaagatagacaaacagataaatagtctatacatggttagtatataggtgaaaggtaattcagtggataaaatacagtatttgtagcaagtggtactagaacaattggacatctgtatgcagaaaaacccaaaaccagttttaattcccactgtataaaaattgacccaaatgggtatcatatgtaaatgtaaaatatacaataatactttcagaggaaaacataggaggatatcttgtgttaggcagagtgcttagataggactctaaaccataaaaggaaaaaagatacattttgagaaagaccagttcagaacttttctctgcaaaagacactgtcaagagaattccaagacagtacctccaagtcagatatctgagaaagaattaacatccaaaatatataaagacctctcaaaattcaactataagaaaaccaataagttcatttaaaaatgggcaaaaggtatcaacagacactttcaccagaaagctatacgcatctgaaaagaatgttctaaaaaaagagaaacctttaccacattcagagcagttgaaactctttttttttttttctctctttttttgagacagagtttcgctattgtccagactggattgcagtggcgcaatctcagcccactgcaacctctgcctcccaggttcaagtgattctcctgcctcagcctcctgagtagctgggattataggcacccaccaccacaatatatatatattttatataatacaattttttgtatttttagtagagatggggtttcaccatgttggccaggatggtcctggactcctgacctcaggtgatccacccacctcggcttcccaaagtgctgggattacaggcgtgagccattgcgcctggccaaaactcttctgcattagtggtgggaatgcaagatagtatagccactttggaaaacaactggcagtgtctttataaaaattaaggtcatatttaccttatgtttcatcattcacactacaaaatatttgcccaagagaaatgttcacacagaaacctgtctgaaaatgttcatacctgctttattcataattgcaaaaaaccagaaacaactcaaatgtccttcagctgttgaatggataagcaaactgatatatccatacaatggaatgctgcccaacaatgaaagtaaacgaagtattgacatgtgcagcagagtgagtgactctcaaatccattatgatgatagaggccagaccgtaagattccatttatgtgacattttagaaaaagcaaatcttttggttggagaacagatcagtggttaccagaggctaagaaggtaaggagggtttgattacatggagcagcacaggatgatggagtgatggagcttttctgcatcttcattgtgatggtgatacacgtatcaaaactctcactgtatgtgaaacgaggatttttactgtatgtaaattttaaaataccttatatgtaaaagatacaagtttttccatgaatatcctttcatattttagggtatgtgtctctgtggtgaatgaaatgctatcctttaaatagtacttctcaggtgacatgcaagtagtataagcctgaagtttttcatttttatccctcaggtgttgaagtgccatcaaaagactctttgccaaagaagaggccaatttatgaagataaaaagaggaaaaaaataccacagcagctagaaagtaaagaaggtttgtatacaaaatagcctctaatttaggaaatatgttgtttgcctttcccccacaatcttcaaaacagtgtctgtaaagaagaaaggaaaaaatccgaaatgcatattgaaacttattttctaaacttatttcttattaatgccattattctcacttgattcaaatgacaagctaatggaaaaagtattttactttgaaaaatctgggttctaccctatgaatattgtaactgttgttaactctgagaagtaaaactaccattcttatcttttcttggtttccttcttagccttctgtgatttttgtattttatttattgagcagaaagagtagtttcctgtaaaacatatgactatatttaaacattttctaaacttgaagaaataggtttgcacaggctgggtacagtggctcacgcctgtaatcccagcacgctgggaggctgaggcgggcggatcacctgaggtcaggagtccaagaccagcctggccaacatgatgaaaccctgcctctactgaaaataagaaaattagcctgtcatagtggcaggtgcctgtaatcccagctacttggcaggctgaggcagggagaattgcttgaacccgggaggtggaggttgcagtgagctgagattgtaccactgcactccagcctgggtgacagagcgagactccatttcaaaaaaataaaaaataaataggtttacactactgttttttattcagtacttaatggagtatcttaacagaaattatacaccaaaaaaaatattatcttggtttctgcccctttttcagtgtctgaatcaatggaattatgtgctgctgtagaagttatggaacaaggagtaccagaaaaggaagagacaccacctcctgttgaaccaggcgggtagtgttatctgattatttaattagtgaattcttattaaatagtgttggtgtgtcataagttgtcttagttattataaataattggggagaaccaaataagtatctggctggatggccctctttcttcatagttctttcttttctatttcttttcatttctactttgaataagtatccaagtgagacttgaatcagttgtgttcttttcagcagtgttagaaaatgttttgtagaaaggatacactttgggagggtgaggcagatggatcacgagatcagaagatcaagaccatcctggctaacacggtgaaactccatctctactaaaaatacaaaaaattagccgggggtggtggcgggtgcctgtaatcccagctacttgggaggctgaggcaggagaattgcttgaacctgggaggcagaggttgcagggagatttcagtgagcctaggttgcaccattgcactccagcctgggcaacagagcaacagtccatctcaaaaaaaaaggaagaaaggatagtaggttttggattttctctgatgcttttatttatgagtcagaaatctcaaaaaaagatctgaaggtcttcatttaatgcttcagaagcaaattggaaggatttttaactagaactttttaagaaccataaaaattggcatttttagaccttcctaaaggtcggcttctatttacaataatcagagaattcaacttactcattgtggggtatctgtgtatatgttgaggagttggggaaaaatctctggttttaaaaaaaaaacattgttctaactcttacgactagatattgatgggagagctggggctgcctaaatgtatgtttggtattcaagagaatccccagcgattaaagataggatcaggaatgggaaaagcctttacagaatactaagcctgatttacattggtgaattatattattgatagttcctttccttctttttctcttttctcttctgagcgaataggatcatctcacctgggtagacctcagcctagcactgatatgacgagattagagaaatttagattgatatgcttaatagcagtccactattttagatcgtatttttagcaccagaaagaattgctaatttagatggatgttttgggtacctgagtctcatttcctcctcaagataacttatgcaggcttgttagtaaataatgattatttcagggaagcaggtaccacatgtcctacccgtcatcttactttcatttaagaatagttgtgcctggttagatttcagtaaagaaaagcattcttgttaagaagagtattaggtctttaatgtctaaataatattcagaattttagctttctggctgttttggggttatgagcacagcattgacccagagtgatggtggtagttttgtaccttcaacttcagaatttaagtatatttaaatacctgtaaaggttaaaagcaaaataataaattccttgcataaagtatgagttggatgatcaaaaagaagatatatatgaaatttcatttgttttcaagaactgagtatattcatgtagctttttcaagatctaaagaaacatttaaattaattaaattaatgaaacaattagcttgaatgtaaaattggttaagtttaatatgttggcagtagtaggaaatggaagcatttaagtaatagtaaattataacatgctagctatattaaaaagatagttctggctgggcgcggtggctcaagcctgtaatcccagcactttgggaggccgaggcgggcggatcacaaggtcagcagatcgagacaatcctggctaacacggtgaaaccccgtctctactaaaaatacaaaaaattagctggccacggtggcgggcatctgtagtcccagctacttgggaggctgaggcaggagaatggcgtgaacccggaaggcggagcttgcagtgagccgagatcacgccaccgcactccagcctgggcgacagagcaaagactccgtctcaaaaaaaaaaaaaaaaagatagttctaaagataatagctgcatacatattttttacataattaaaacattctttttttatgtcagagcataattttttacttttttctaaaagaccttcatatttctaaataatttttgtgtcttaaatgcaaatttttacttacagaagaagaagaagatactgaggatgctggattggatgattgggaagctatggccagtgatgaggagacagaaaaaggtgaatacctcataagcacacactgatacatccagtggttattagaaatgaatgatatatatttaaatgaatagtcttttgattatgaaagccatatgaacatttctggggatagggataagtctcttgttctctcctttgccatggtttctaagtcctcaagtggatcttcattttgtgaatgagtggttcctcagaatgttatttgtaagatagctgcctaaggtttagaatgcattttttcagagtgatgatgttacaaaatagggttgttactaaagctgacctacaaaaagcactgttaacttaaaaggtaatgagataaatactatagttcctgataagtatgaatagaaagtaaacgtttttgtcattgtttccccttctttattactgaaatctctacttcgagatttaatttcctgttaattttactaacttactgataatgatatctggctctttgatttttttcagcctccccccatctttgtttttaaagctatacctttttctttaagcatggctttagtcaaattctgtaagtctgatatgttgatattttctcattttcattttgatgtattaagttttacaagatttatttagtgtatttcttttttttgagatggagtttcacacttgttgcccaggctggagtgcagtggcgcaatctcggctcacaacaacctccacctcccgggttcaagccattctcttgcctcagcctccagagtagctgggattacaggcatgcgccaccacgcccagctaattttgtatttttagtagagatggggtttctccatgttggtcaggctggtctcgaactcccgacctcaggtgatccgcccgccttggcctcccaaagtcctgggattataggtgtgagccaccacagcccgcctagtgtatttcttaatttacaaaaatgggcattttctaattgtcttttgttacttcattgtgatcagagaagatacatgattctatcctttgaaatatgttgattattgctatacaacctagcatggtcagttattgtaagtgtttcatgtttggaaagaatttatattctgcagtagttggatgccttgctttctatatttaggtcaagtttgctaatcattttgttcaagtctttcatagcgttctgagggtttttttgtttttgcttttgttttttttctgatctgttttttctctctgttactgggaccaatgccttaaaatctcccatcatgattgtagattgtctatttctcctgagttctgttaatttttgctttatgtatttttatgctgtgtcattaggtaaacacaatcttgtatctttctaatgaattgactcttttatcattgatatatatatttctaacaatgccttttgatataaaagtctacctaaaactcatataggtacacgagctttgatttacatgatctttttctatctttatgactctttttgtatccgtaaatagcattatcttagtccatttgttctgctgtaacaaaataccacagactcagtagtactaaagaacagaaatgtgtttctcacagttctggaggctgggaagtccaagatcaaggcaccagcattggtgcctggtaaaggctgctgtctgcttccaagatggcaccttggtgctgcatcctccagagggaaggatggctgtgtcttcacatgatggaagggagggaagggcaagaggagcaaactctctttgaaggcacttttctgcgggcgtgaatccatttatgagagtgacttaatcactccccaaaaccttccccaccaccctcctacctcctaccagcaaaatggggattatgttttaaacatgaattttagaggggacaccatttacaaatcacagctaggatctagttgagattttttcaatccagtttgtcaatctttatattttacctagagtacttagcctgttcattaaatgtaacatttggtgtaattaatgaagtatattgattttaaacatttcatcttactaagtcgttttttgttctgcctggttctttttctctcctttctaatcatcttttggttactaggtttttaaatttttatttttttttcctttcatgagcttagcagttgtatacctttcaaacaactttttagtgattaagaaaatttttagcaagtacctttgaactaacaatgtctgatgttatcctctaacaatgcagggactttagagtacttgaatgacatttacccaatactctatttagatatcattgctctcggccaggcatggcggctcacacctgcaatcccagcactctgggaggccgaggtgggcggatcacttgagatcaggagattgagattagcctggccaatgtggcaaaaccccacctctactaaaactagaaaatttagctgggcgtggtggcgtgcgcctgtaatcctagctactcaggtgactgaggcatgagaatcgcttcaccctgggaagcagaggttgcagtgagctgagattgcgccactgcattccagcctgggcgacagagcgagactcttacctaaaaaaaaaaaaaaaaaaaaaagatataatttttctcatttcttttcattatctatttaaaacctcaaattagcttatattttatatagtcaatacttactatttataagtttacccacattcttaacattttgttgcgcttcgtttcctgcatcttgtaccttccatttgagatcatttcttcctatctgaagaacactttagagttttttttagtatggatcagttagtaagacattctgttttgctttctaaaaacatctttattgcatcttcattctttagttttatatgtttactgagtgaggaattattggttgaagtttaacactttgaagttattattcccttgccctggctttcattgttcctgttgagaagtcaggtatcagcctaaatttttcatatggtcttgcttttcagcagttttatcatgacgtacccagaataggctttttaaaaatatattctacttgtagagctttattaatatatggttttatgtttttatcagttttatgttaggagtcattttctccctcagaattccaatgatgtctctgataggccctcttattgtatcattgtttcctattttcttttctgtattttccacctagtgagtctctgtggttcattctggattgcttctcttgactgtcttctaggtcactgattttctccttggctctttctattctgaggttagatccatcttttgagttctcaatttcatttgttatatttttcagttttagtatttccatttaactttttttatagttttaattcaccttctaaaattttaactttgtcttttgcttctgactgaatgttagaagcacagccattttaaaattttgattttatgactttattaaagtccttttggtgttttatatgttggttcttctcacgtaaattgttttctcatgtgccttgctatttttatagctggatattttgcttggagaagtaatttgaggtcaaggatgatgttttcttttctccagagctaatttatgtgttacttccacaaggtacctgagtgaactagcaatatggaataatcttattctagatttagaatccagaggatctgaaggtgatctgccaataatggggagatcctgtttatttcttattcatccttattcctagggtacagctcttcatgattgtaccccacagtaagggtgtaacccaatgtctgctcactgcaccccactgaattcttagtattttggtaggtctggactcccaatgcagcttagcctttcatctgcctcttcccgaatcaacaaatgaccataaggggaaagtggtactaaagactgttccacctccttgagttttgttctcccatggattctgtcttactaatactgacttcagtctggattactgccttaaggttttactgttaagtgacagatttcgttttagcatatagacaaacaccttgcgtttatgatgtatgaaaacaccatgttactgccttaaatacaagttgagcctctgaaattcaaaaatctgaaatctgaaatgctccaaaatcaagtttgagcaccactacgtgacgctcaaaggatatgctcattggagcatttcgtatttcaggtttttccgatttcagatgcaaatattccaaattaaaaaaaatatgaagtaagtatagaatgcaaatattccaaattttaaaaaatctgaaacagttctggtccaggcattatctcctccccttactttaaagcaggcttgtccagtctgcagcctgtgggccacatgcagcccaggatggctttcaatgtggcctagcacaaatttgtaaactttcttaaaacgtgagacttttttttgtgatttttatttttaagctgatcagctattgttagtgttagtgtgttagtgtattttatgtgtggcccaagacaattcttcttgtaatgtggctcagggaagccaaaagattggacacccctgctttaaagtctcttatcttgatataaatctatcatattaatgtttatttatttaaaaatatatttgctttcgtagtagaaggaaacaaagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgaggtatttattttaccgtttctctctacttttcttcccactcctctgtgatgattaaaacagtactctacaactaaaggctttgaacagcactttatgtattctcaagaatagaacaccgttcagtttttgtaatgttgaaatattactggcctttgatactggtcttacccaaggaccccccgtccccgctcttacctaagatagaatggtgtgactacttcatttttttcttgttttctccaaattttaatgtactctttgagtgatagtttataagtatgcagaggtattctgagcatatgccctctgcttataaacatcagttatgtgtttgcctcacatatttaggttagtcaccatgaggcatctgatcactatagttatataaatctggtgggttgatgaggcttctatttagtaaagtccgatacctgatagactttctgtatttttcctacttaatgcagtagatttcagtatgcttcaagagaaagttttctttagttctgtcagcttaatgtaaataatacattaaaatctagtttgcttgaggatattaaactattttaaagctaaaaactattttagctttcctttttgtgtattattaattttttaattttttgttttactacctatatatcaacatttgctttttctcctgtaaagtctaggtatggataaattgtctaaatttctaaaggactaagaggatttgttattctaaattagggtttctcagccttggcactattaaaatttgggggccagataattctttgttgttggggacagggactgttctcttccttgtatgataccaaacaacatcttggcctttgcctactagatgcctgtagcattcttccccacctggcacctcagttatgactgtcttttcccgtagcacctactcccaccagctcccttgccatatacccatgttcgagagagtgatggaatatctgtactgtgcttgctgattaacaaacaaaataagtataaagcagaagagtttctcaattatcctgctccctagattagttaatggtagtgtgtatgagcttcatgtttttaaaaataaaggccctagcccccaatatagtcatatgaggggttagggcttcaaggtaggaattttggggaaatgttcagtccataacaaacttcatggatccataaaccttgctacatattatgattttctgaaattcactccattcctgggtcagaatctccattgtggaatggggtttgtattcttgtcctgtcattgcttcagtatacttagaatttctgagtcagtttgtaacttattgccctccaaaaatttttaacacttcactaagtgtgggagagagaggcagttttcagccatatcaaataaagtcatgatgtttgaatttgagttgtatgtactgtgaggttgtcgggtactactctttgctagtgattaagtcctactttgtgctcatccctggcatctcacttttggtattttaaaaagtttttcagtttcagtttctaccaaaaaatctaatgtctagtactagaaatgcaagtaaagggttcttacagaaatggtttttagatgaaaaatagttttgtaaatgacattacttcatagtttttgcttcaagtttatctaatttgaatgccaactttactgtatttgagaggtcatttcaaagaaaacctattgctggcatgtgtttttggtcctcagaaagctgaagcatttaggtaaatgcaacggagaagcacgttgtggttcaaggaaaagctttctcgctcttactggtgttcataaagtggtagagccttggaaagtcaggacatgttttacttatttaagctgaaccttaaataaacagtctcctccttgaaaggttttatagcatttgtatattggataaaagtgtgaaataaattgcctttaaaaatctttaaaattcttaggttccagtgaattttttaaaatgtacaagttcacctgtttttatataaatcctcacacaaattcagggttgcactatatagtcagtatgatgggaagattgattccttttctagtcattatattccattaaagtaactgtgtacaaaagtattcaaaaattttgaaatgacactttacaatattcctattcgtattcagcagtgctgctgtgaaatctaaacaggtttttccttatccagaggtgctgtgatgggaattcgattgtaaagttcacattataaattccaattatgtgtagtcaaatcaacaaagaacttggatgcaggttgtagcattcttttgccaaggcaaaacagaaaataaggatagtgaggatttgaaataatatttaatttttgatttttttttttttttatttctagaaacggcgacttgaacatagtaaaaatgtaaacaccgaaaagctaagagcccctattatctgcgtacttgggcatgtggacacagggaagacaaaaattctagataaggtaagaaagtattaaatgtattgatagaactttgaaaataagtgaatggtaccttataaaaaaaaactttagagaccaataggacatataagcaattctgcttacaataaataagttgctaatttcttattatttttgctgctatcttttccatgttcaaataccaatctgtatttgctgtcttctcatagctccgtcacacacatgtacaagatggtgaagcaggtggtatcacacaacaaattggggccaccaatgttcctcttgaagctattaatgaacagactaagatgattaaaaatgtaagtacattgtatttcatgtattttaatctctgacaaaaattaagatatgaactatttcaaacatagaaaaaggacagagactaggataacagctccatatactcaccattcagaattaacatgtactattttgcctattttgctttagatcattctttttaaagaataaaacactacatattataggagctctcacattccatttccttccctccctctcccagaggcagccactattccacagttagtcatttgcctccatgctttaacactgataccatttatccccataatttaaaattttgtttccttctctactcttttccccttctaatctaatcaatttcttttctttttctcccatatttttctacttgtttggaggtattcagtttatgtatgttaaatgtaacacagtaagataaatgtaaagcttaaagaatcagtataatacacaccaccctttaagtgtcacctttgttgagcaatataaccttgcaagctgcttcagaagccctccaggtgtagctttccaatcaaagatctcttctccagccacaactttttaagataatctctaccttttaatgtgttaggagttgcaaaatgttgatactcgaactccatcagccattattggattacttctatagagaaacgttacctaatctactatttgattattcagtgatggcttatttaggaaaggcagaattaatgcctgatcctttaccttcttttaaccagcttttaaaataaaaagtggccaatatgattttttttttcttttgtttgcccttcatagagacagggtctccctatgttgcccaggctggtcttgaactcctgtgctcaagtgatcctcccacctcagcctcccaaagtgctgggattacagatgtgagccactgtgcccagcctgattctgttttgtattattatgaactcatggatttaaacatatttactgtgcattagtccatttcagttattattgtgctgagatagtcccatctttgcccagtggttggctcttgaatctttctcatacaattctggttgtcctagttttggttgcattcatgctgtctgatatagcaggatgttcccggctcatgtaatatagaaactacccagactgagaactgggccttgttaataattcctcagtttcattatcacagagcaggtgaaagtggtagctttggaactgagaagcagtaagttgaaaaacaaacagagcatatgttattatatgctaatgtccccttttattccttattgagtcttagttctgcatgtaaaaagagtctatgagtttgtctctccagtttttgttttgtttctttgtgactgggttttatgaagcgtgtcttctagtcaatttctaaggaaggaattagaagaattaacattccttgaatttttgaatattgaagagttattttgtggcctttatactggaaagtcattggccacatataaaatccttggttgacattttcattccttaagtatcttgtgtcccatttattctcgcataaagtattgctgttaagtttgatcatcagctgaatttcgtctttttataaggcctatgatcgttttacatcttgatgtcgcttctgagttttccagttatgtggtgttctattataatatgtagtagtgaatttttattttagaacagttttcttgaattatagcttttcaaatttataatttattttcatcctattttaaacagtatttctatgttttagtcactagaggagagggttcataacaccttattccaccagttgccagaacttgaactctcgttgttattttagaacgtaaggaacaagattattattaggcctgtattaaagttcttgggataacctttatatgacaattgtaattacttactgttagtatataagacactaaagtggaaataattatggtgctcagtgaaccagaatgcggatctgaaatgttttacgttgcattattttgatgtagatcaggataccaaattttggaagatcatttgaagattagcaaaaagaaaatgtagataagcataatacaaaaagggggtgtgtgtgtgtgtgtgtgtgtgtgtgtgtgtgtgaaattagttggtcagtgttactttttagactaaaagggaatgtccagattagatctgttgtaatgttacttccattcatttatgtccttttgtccagaaagtcaagcatttatgacgttatttgaatacaacagggtatgcatttactctttaacacttttgatcaatgtggtaaatttactttaaaatgtacttttgggatatatttgaagtcagaattgctttaaaattggaccacataaattttcccaatgctgagaaccacctcttgcatgtcagatttctatagaatatttcagatgactgccctgcgattcgtatcaccacttacttaataatctgctcaaacttggactacagtcatagttgtaagaccttaagaaaggagatattttctcatttagtatttttttgttaaaatgcctttggattttaatgaaaatactgacaactgtactttgctggttaactcactgtttctaaagccatttatatggaaaagggagtagtgatactttcagagttttatggcaaaaggattgttctgtaaagaagctttcatgtctgactttcttaaactttgaacttttccccattgtttctagtttgatagagagaatgtacggattccaggaatgctaattattgatactcctgggcatgaatctttcaggtaagagcaatttgagtcttttctcatcaagcaatctacttgaaaccattaagtctaaaagttcagcagagtcattaacctttgagtagtaatttgatctctataactaccactccacctttgtacctcattgatttagtaatgttttctttgaatacttgttttttatagagggaagtctttactgctttaaaagagcacccccttaatgtggaatgcagaaaacatgctaatacatgccaggcctatctcctgtaaaacccgttacaagtggaatattatgctgttgtctcttgtccatattctttaacacagaaaacttggtcagtaaaattattagaaatattagttggttctaaaactagctcattccacttgaggtcaattcaagtgattggtagatgagcctttggcaagttaagggctaatagtacttgaacaatttaatacatatactctattttgtttgggttttacagagaagtttaaaagtttaagaaaagtattaatttcaagattttctacttatagatcttttccttcttttcaacagtaatctgagaaatagaggaagctctctttgtgacattgccattttagttgttgatattatgcatggtttggagccccagacaattgagtctatcaaccttctcaaatctaaaaaatgtcccttcattgttgcactcaataaggtatgtgcgccttctgaaaaattaacctaggaaaacatgtttcttaattttttgtgattaaaaaaagtagtataattaacttacaagcatagctcattttattgtgcttcactatattgtgcttcacagatattgtgtgtgtgtgtgtatttgtgtatagttttttttttttaaatacaaattgtaagtttgtagcagccttgcatcaagcaagagtattaagtctgttggtgccatttttccaacagcttgtgttcacttcttgtcacattttgttaatttgcaatatttcaaactttttcattattacatttgttaggttatctgggataaatgatctttgttattttaattgatttggggtgccacaaaccacacccctataagatggcacacttagtcaatacatgttgtgagtgctctgactgctccagcaaccagctgttcccttgtctctttctctctccttgggcctgtttcctgagacagtattgaagttaggccaattaataagattacaatgacctgtaagtgttcaagtgaaaggaggagtcacacatagaatatcagtccagccacaacactcccttaagccaaagcctaatctaaagcaaggccctctcttcaattctgtgaaagttgaggaaggtgaggaagctgtcgaagaaaagtttgaaaccagtagaggttggttcatgaggtttaaggaaagaagctgtttctgtaacctaaagttacaagttgaagcagcaagtactgatacagaagctgcaacaagttatccagaaactctagctgagatgattgatgaagatggctacactaaacaacagattttcagtgtagacaaaaaagccttctattggcaaaagatgccatcttggactttcatagctagagagaaatcactgcctggcttcaaagcttcaaaggtcaggctgactctctagttagggtctaatgtggttggtgactttaagttgaagccagtgctcattgaccattctgaaaatcctagggcccttaagaattatgccaaatcctttgggaggccgaggcgggcggatcacgaggtcaggagatcgagaccaaggtgaaaccccgtctctactaaaaatacaaaaagttagccgggcgtagtggcgggcacctgtagtcccagctactcgggaggctgaggcaggagaatggcgtgaacccgggaggcggagcttgcagtgagccgagatcgcgccactgcactccagcctgggtgacagagcgagactccgtctcaaaaaaaaaaagaattatgccaaatccattgtgtgctttataaatggaaatataaaacctggatgatagcacgtctattcatagcatggtttgctgaatattttaagcccattgttgagaccaactgctcagagaaaaagattgctttcaatatattactgcttgctaacagtgtacctgattacccaagctctgatggagacacacaaggagattaatgttgttttcgtgcctgctaatacagcatccattctgcagctcatggatcaaggagtgttttcaactttcaagtattgttacttaagaaatacattttatacggctatagctgccatagatcgagattcctctgatggatttgggcaaaagttgaaaaccttttggaaaggattcacccttctggatgttatgaagaacgttcatgatccataagaggacaaaatataaacattgataggagtttggaagaagctgatttcaactctcatgtatgactttgaggaattcaagatttcagtagaggaagtcactgcggatgtggtagaaaaatagcaagagaactggaatttgaagtggaaccagaagatgtagctgaattgctgcaatcttaagtaaaacttgaacagatgagaagctgcttcttatgggtgggcaaagaaagtggtttcttgaggtggagtctccttctggtgagggtattgtgaacattgttgaaatgacaaaaaagaatttaggatagcaatcaacttaattgataaagcagtggcagggtttgagaggattgactccaattttgaaagaagctctattctgggtagaatgctctaagcagcattacatgctacagataaatttctttttttttttgagacagagtttcgctcttgttgcccaggctggagtgcagtgctgcaatctcagctcaccgcaacctctgccttccgggttcaagcgattctcctgcctcagcctcccgagtagctgggattacaggcatgcgccaccactcccagctaattttttatttttggtagagatggggtttctccatgttggtcaggctgtcttgaacttccgagctcaggtgatctgcctgcctcggcctgccaaagtgctgggattacaggcgtgagccactgcgcccagccaatgaatctttcataaaaggaagaatcagttaattgatgggacagacttctttgctgtctcttttaagaaattgctacagccaccccagcctttatgagctaccatcctaatcagtcagtagccatcaacatcgaggcaagaccctctaccagcaaaaagattatgacttgttgaagaatcaggtgctcgttagcatttttagcaatattttaaaattaaggtgtatacattgctttttttaagaagatataatgctgtcacacacttaatagactacaatatagtataagcatctcttttagaagcactactaggaaaccccaaaaattgtgtggcttgctttattgtagtattagctttactgcagttgtctgaaaccaaacctgcagtatctctgagttacgcatgtataagaaaatgcaccccatgctaagtgtttaatttgttttgacaaatttacaaccactgtcattcagaacatagaccatctccatatttccagaaaagttctctcatgttactttgcagtcattctgctgccctccctaaactcaagctagtattgatctttctgtgtcatatggactagttttgcctgttttatgatttcatataaatggaatcatatagtatgtaattttttaagtttggcattttttgttactcatgttattatgctttgttcatgttgtcattacatgtataaagggtttttcctttttatttttgaatagtagtccattatctgaataatactgcactttatccatttatctgttgagaattctagttcctgcatatctttgcgaatactcgccctacctccagcattctagtaggtgtgtagttgagtgcaaaattattgtggtctagtttgtttccacagtgactaatggctttatgcatcttttcatgtacttatgcttagagagatgaccatatctgtttctttgaaaaatatgttcaaaatcctttgttctttattagattgttttattgttgagttttaagagttctttatacttctggttctatgtatataattcctttttcacttgtatgtactgctgatgtattcttatggtctgggacttggtttttcattttctttgttttgttttgcgtgtgtgtgtgtgtgtgtgtgtgtgtgtgtgtgtgttggagactgtctcttgctgtgtgtgtgtgtgtttttttttttggagaccatctcttgctgttgcccaggctggagtgcagtgtggcgcactcttggttaactacaacgtccgcctcccaggctcaagcgattcttgtgcctaagccacaggtagctgggattacaggcatgcaccaccacacccggttagggttgtttttttctggggggcgggggggcggtgtgtgtgtgtgttttagtaaagatggccaggctggtctcaaactcctggcctcaagtgatccaccgctttggccacccaaagtgctgggattacaggcgtgagccaccacgcccagcctccttttcttaatagtgtgttttgaagagaagaaatttctgattttggtgaaatccaactaatttttatattttatttatttttgggacagggccttgctctgtcacccaggctggagtacagtggcattatctcagctcactgcagctctacctcctgggtttaagtgattcttgttcctcagcctcccaagtagctggaattacaggtacatgccaccacacctggctgatttgtatttttagtagagacggggtttcaccatgttggtcaggctggtcttgagctcctgacatcaagtgatccgccagccttggcctcccaaagccctgggatttcaggcatgagccaccgtgcctggccccaattaatttttttacgatttgtgttctatgtaagtaatcttttcctatcccaagttcattaaatttttctctggtgtttccagatgtttaatagttggagctttttttacattgagatcagtgatcttttttttatatagtgtgaggtcagggtttactttttttccatagaaatattttgttatttaaagactctttgctgaaaaaattatttttttccccatggaattagtttggaatctttgtcaataattaattgaccatatatgtctgttcctagaatttatcttttgttccattgctctatatacattcctatgccactactaccctgtctcattatagcttcatagtaaagttttgaaagctggtagtggtaaatccttcaacttagttttctttatattgttttggctattttaggtccttggatttcaatataaagttttcagtcagcttgttcgtttccacaaaaagccttttaggattttgattgggattgcgtttcaatctgtagataaattttgagagaattggctcttttagcaatattgcatcttttgatcagtgagcatggtatctctgtacatttacttagtcctctttaccatttttaaaaattatttttcattttatttatttttttaaatagagacgaggtctgtgttacccaggctggtctcgaacacctgggctgaagcaatctgcccacgtcagcctcccaaagtgctaagatttaagacctgagccaccatgcctggccaggccttctttactttctcttggcaatattttgtagttttattgtccacatgttggacatatttttctgaatttatccctaagtatttcatggtttaatgctattgtaaatagcatgaaaacttcttaaatttccagctgtttatcacatttacactcagtttgtatcttgtgaccttgttaaattcactgattaggcctagtatcttcttttgtaaataatgtgagtttttctaagtatgttgttatgttatctgcttataaatgcagttatgtttttttccccttacctatatgctttctacatctttttcttctttattgtactaactagaccttctaaataatgttgaatagaaggaatgacagtagacatcatcctttccttattcctgatattaagggaaagtgctcagtctttcacccttaagtatgatgtcagctgcagggtttttgtttttttggtttttttgtcaatgccctttattaagtttgaggaagtttccttctattctaggtggtttaaagtgctttatgtttttatttctttaatcatgaatggttgttgattgtgtcaaattcttttcctgcgtatgtagagatgttcatgtggattttctccttcattctgttaacaacataattactgttgaatttttagaatgttaaaccaactttacattattaaaataaaccctagttggttgtcatttgttatccttttgatatattgctagatttgatttgtaatgtttcattgttgttttgtgtctatgttcatgagtgatatgagtatgtagttttcttgtaatgtcttttatctggttttcatatcagagtaatgttggcctcctaagacgagttgagaagtgtttcctcctctgttttctgaaagaatgtgcaggaattggattatttcaaagaattagcttttggttttattgatattcttttctaatataagcatttaaaagtgttaatttctaattactagttagacatgtttttattatttagctttacaagcttcaggcttttcctttaaaggtgttgagcatgtttataaatattctaaggacctcatatgctaattttaacatcttcgtcatttcctactgatttgtctccttagtagcattcagattcgtctgattctttattttgtcaccctagactctgtccccagacagattatgcttttgattgtttgtttggctagcaagtatttttcatttcttctatgctcatttatctctcatgttgaaaagtgagggaaaatagattctgtcattaacaaaacagatttaatcctaatttgagcaataaaataattaaaataggctgttcccttagaaaatatatattttttaattttttggtatataattttatagtgatggtacttgctgggattgattgatttgttacaaaaactgtttcggaattccaacaatatacattaatagtcttaggataattctaggatgttatcttttgcaaacaaatggcagccacttaggaactcatggaggctgacaggggcagcatggcaccacagcagtttctaatttaagagcaggtgccgataagcagtctgaaaggagcttttggtacaataaagtgtatgagtaagtcacactgttctgtatatatgagacacacatgaggaattttctggagctattaatacagttcttgaatgttctgaattttttagagatctttctcatgaaaaaactttttcagattgataggttatatgattggaaaaagagtcctgactctgatgtggctgctactttaaagaagcagaaaaagaatacaaaagatgaatttgaggagcgagcaaaggctattattgtagaatttgcacagcaggtaagaaggccttccttctttctgaagagcctatctcagaatatgtattatattatctttataatgaagtcagcattttcattaatactggttcttttcctctgttgacagcaattactttttttaaattcttcttcccttttctcctttttctttgcagtctgaatactttaatttagaaaactgagttgacttagaactactttgctataatacagttaatgcttataggatatacatgatcatttttagtgtttatgaggagtttcaaaatgatgagccatttgctcatccggcttctagtgaggcacacctattccagatacgttttctttacagcctggcattttggatgatttttgctcctagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggtaatgatcaacttttcagtttattgttttttttttttttaaaaatagcaagttccttgagtggaggatatttactacttttagatttaatgaacatggtgcattgtatgtatgtctttctctttgcattaatgccttttaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaaggtatgctgaggtgggaagcattgacacgtggggacttgtacagtgtttagaagttctgctgagatggtttcctcactttgaaagctgtttgacttaatacagaacacatacatccctcgctctcccttttattttagttgtcatcatacaggaaggcctgtctgtcagagtagagatgtgtgaaagtacctgcttaccagactgggcctttgccagattctaaactacactgttatggttctacactgctaaatacggttgactcttgaacaacatgagggctaggggcactgactccctggccagttgaaaatccacatatattttttgactccccaaaaacttaactcctaatagcctaccattgaccagaagccttaccaatcacatacacagtcgactaacatgttttgtatgttttatatattacatactgcattcttacagtaaaacaagctagagaaaagaaaacgtgattaagaaaatcataaggaaaatagatttactatttgttaagtggaagtggatcatcataatggtcctcattctcatcttcatgttgagtaagctgagagggaagaaggagaggggtaggccttgctgtgtttggtggcagaggcagaagaaaatctgagtataagtggacatatgcagttcaagcccattttgttcaagggtcagctgtagttttttaacatttttaattgtgaaataaaacattgctcctgaaaagtacacacaacatagaagaaaagtttaacacatttttgggaagcaaccagatggagaatcagaacgctgctggcacccagaagcttcctgtgtgcttcttcctgatcaactcccctgccttcccctcctaccccctgacctttcatagagttaaccatggttgcattttatgacagtaacaaatatccttgctttgctttgtttttgtgtctaagagtacttcccttagaagtgtctgtagactttatgtagaaatggagttattctcagtgtgtacttttatagctggctctttttttttttttttttttggtgataggctctcactgtcacccaggctggagtgcagtggtgcagtcacagttcactgcagcctcaacctccccggggttcaggtgatcctcccacctcagcctcctgaatagttgggactataggtacgcaccaccacacctggctaatttgtttacagatgggactttgtcatgttgcccaggctggtcttgacctcctgggctcaagcaatccacccaccttgatctccccaaagtgctgggattataggcatgagccaccatgcctggcctatatctggcttcctttagtgaaaaaaaaaaagtatataattttaagatttctattccattgtgtgactatatcacaacatatctatctgttctgttgatgggaaatgtaggtgatctccagttttttatgtttattttattttattttattttgagatggagtctcagtctgtcatccaggctgggattacaggtgcacgccaccacacccggctaatttttgtatttttagtagaggtggggttttgccgtgttggccaggctagtctcgaactcctgacctcagcctccctaagtgagccaccgcacccggcccagtttttgatttttgttgttactaataatgctgctgctgtgaacatctcttgatgtgtttgtgccagtttcccagggtatgtatacctaggagtgaaggccacacttgtctacagtgggtgtaacaaattatattctcaactgcagtattttagtttcattgttttacagcttcatcagttcttggatgttaggttttaaattttttttgccattctgctaagtgtgtagctcattgccgtttcagtgtgcatttgcctaattgttaacctggttggtcatttaaaaatgtttattggccatttatttcctccttcgtgagatgtacatttttcttctgcattatctttcttacagatttatatgcgcttatatattcaggataccggtttgttagttggtgtgttttgcaatatcttctactcttgtgactttttttttcctgtggtattttgagaaatggaaatatttaattttaatgttaaatttatcagtcttgtgattattgctttttgtgcctcgtttaagaaacctctctctaatatcatgatgagattctcttatatcatcttctactgctaaccacttttaaagtacatttggtaacaaatgtttttatctctgtagaaccagtatgaaaagcataaagaagtagaagcagctcagggggtaaagattcttggaaaagacctggagaaaacattggctggtttacccctccttgtggcttataaagaagatgaaatccctgttcttaaagtaagttcatttaaaaatttttttccttaaaagctatttgagttctggcatgtgtcagcattgcacatgctagggatggtgaccaaaactggctttgtctttgtgaagcctgccatttcttggcctcttagcaaacttgatgcttttgaattacttcagtttgtacaatcatagaaattggtataatttttatatgtactagaattataaaaataatgcattttattcaaataaaaaaatgagtcaaaagctagaagtcggctgggcatggtgaatgcacacctgtagtcccagctacttgggaggctgaggcaggagaatcacttgaacctgggaggcagaggctgcagtgagccaagatcgtgccactgcactccaacctgggtgacagcaggaccctgtctaaaaaaaaaaaagctagaaattgtatattctttttggcccatgtccattgtagtttcataaaagtggactttgagccatagtttgttcatttgccaaagagaaaatacaactgttcccagcacatggctcttgtgtcctggggccgtgtttattatttaggcagcatcaagtcatgctgttgggaataagctatcttagggccagtgagagaatagggcaggcctgtctcttcacccagtcctgagtatggagtggacttacgtcccttcagtggcattgataaacttgttttacttatttctggttaaaaatctcttcttccatttcccgacaagcagtgatggaggaaggagctgctgagatcatgagattatggtatttcctagttaacacagacaagctgaacttttgggctatcataacacattacgtttatgtggtacttttttaactttaaaaaaatttttcttctctactgtttaattctgcccacccatctactgtatttgccaagtggagcggagattaaacatatttcaaagttagtaaacctaagacaaaggtgaagcgaaatacagttagggtatggccccgaaatctcctccttcattccagcacaggttctgtgatgccttgctctatctaagccttagtttcatatttgcagatgagtacttaaccaaagagagaaacacaatttaattctagactgctgaggatagaggtgtgttgacaaccttatcaaatctgatttcttttcaaggatgaattgatccatgagttaaagcagacactaaatgctatcaaattagaagaaaaaggagtctatgtccaggcatctacactgggttctttggaagctctactggaatttctgaaaacatcagaagtgcccgtaagtaactacaactcgctccacaagtgaatggtggttggtcgtggtttttggtgccatcgccattacctgatacatacagataaacatggaaactcccattttttcagtatgcaggaattaacattggcccagtgcataaaaaagatgttatgaaggcttcagtgatgttggaacatgaccctcagtaagtaatttctcttgctatgaaggctttcatgttacgtagctatcttaaaactgtcctatcttaaaaaactgtcctctgtgacatactctgtttttcactgaatggtctttgatgtgttttaaccttttaggtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagtaagttactgtttttatttactttgagtctttgttaatgaacatgattgagaattactgaattccagaaagggctgtaaacagcaaaatcatggcatttactcatctaccagaggctgcatcctgaaatggtgtgttacaaaccagaaacccaacatactggggacattccagcagtatgcaaacaagtcttgtctgtgacttcagtttaataatcttggcagacttgggtcttgttaatgggttcgtagttattaaatgtagggactttatgttgctcatctgggattatatagattggaagtaacaaaacttgagtgaggaaaaccgggaaataagagattctgtgggagagaagtccattcctctaccaaactttcactcaagcactcacagtacctacattgctgcagtggtagaggaggcatcagcagagaaccaggccagcctccctcctcctttccctttgagacagggtctcgttctgtcacccatgctgcagtacagtggcatgatcatgggtcaccccaacctctgcctactgggctcaagtgatcctcccaccttggcctcccgagtagttgagactacaggctcacaccactatgcctggctaattttttgtatttttggtagagatagggtttcgccatgttggccaggctggtcttgaactcctgagctcaagtgatccacctgcctctgcctcccaaagtgctgggattataggtgtaagccactgtgcctggtctgggacatgctcttattgcaggacaattgacacatgttgagaagtgctgaaaaaccaaataaagcagggaagggcctagataaggagaggagggactgtgattaatgatgtggtttgggaaggcatctcacctcttcagacagagtaagccacacaggcacatggggagtgtccagagagaacagcagtgcgaggcagagtgaccagaagggacagtgataaatgaggtcagagagggtggcaggacctgtatcgtcaaggatcttacaggccatgggagggattgagcttctctgagttttgcaagaagccattgccaaggctgtgtgttcacaatcagactggttaattgggttgttatgtggaccttgggttgttaggaagtcagtggcaagagcctgtcaggaggctcccacagtccaagcaagaggtctaggtgattcagaccacagtgatgataggagtgatggcgtagtttgggatacatttttaagtggagcttactagtaaatattaggatttagactggtatatgctcactttagatcatgaaacctgaagtgagaagaattctacttaacaagactgctggaaacttttaaagcattttaagcgtgtgctcaataagcagggtagttatgtagtggccttttggatcaatggtttgggaacgtggtggagaaaaggagggtgataatacggtctgatgcctatgtgatcccccagtagcctacatatgtgcctaacgaagacctgcctgtcaccaggtactgcctaggttctaagccccagactgtggctgacatcttcagcagccaagctcagtgttttagactaggaacagaatgctcctgtgatgcagcttcttttggaggtagggctttaaaagagaagaaagcaaagacttgggaagcaacagaatggggaggaggaggttaagaacaaggaagaagcgctctgggcatggggtggccctgggctgcagcaccctgcctgcccctctcctgtggccgctggggaaagctgctttcctctaatgggagaagcctgatgttcagctgcagtttttctttttatgtttaagtgattctgtaagcttaaaattcttttcttttttcctttcaggcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaatgtaagttctagttgtacattctgtgggtcatttcttaaagcactaaatgagtgtccaagagtcgtaccaacacagctttgtgcctgtagttcacagtactgtgctgtgtatttagtgtggtctccaccttcttaacaaatgtttcagtgtttttacctcagtaggaagaaaatgtggtaactttaaaacaagcagagcctgtcaccttctgttgtgcttcagtattggtaaatatcagtgctccatagtcagtgttgactcagtgctgatctcagtgcttcagttaattggggctccaaggcactttacattattgccttttattttattttgaaaggtttcaagcctgtggaaaagtttaaaaactagtataatgaacactcatgtttaccttccctttctgtcagcatacctaagaaaaattaataatatttcaacaatatcctataatttgcagccctcaacattatttcaccagttattccaaagatgttttggtaactctccccaccaatctggcccagtgccctgcaagctgcattgcactggggcttgttttgtggctgagcctcagtcaagaacagtcctccattctttttgaagtgtccctgttgttttgcaaatccctcctccatttggatttatctgtttctctccctcccaactagacacaggttagaattattggaaagacactcatgcagtttccctgtgtgcctgcctcttgcatgacccagcctgtctgactgctgctgatgctctgatttcctggggaaagtgctagacgccaaccatctccattagaaacttgcccctttataattactctgtaatctgtctggtacctggagttcctaatggatatcctgtttctcaacagcctttatcccagtgcctttagtacccactggcaagcgttgcctaagtcaactattacgtagatggttgcaaaattgtggatatacctgtccccccatttcttacaaagaacctcttcccactgacctttttattgagtcatagactcagtgggtttttttttttttaatataatccattacctttattcttttgatactcagattttctattgtggtcagtaggagctcaactggctcctgtatccttgacacacagcagtctgagcatcatcttcctttctggttgagatgttccagcctcatctagtactttccctggcccaaacctggttcttgtaatgggcaatggcacttagaagttgtcattgcttttctaccatttcagtggactaagcctggacatttatttgtgttactttctatgtggctttggcctcctaaaccaaccagagctctccctgttttcactcttactctcctgaatctttttctccacaaaggagtcagggttttttgccccaaactctgagatcacatcactcatctgctcacaggccatcattcttaaaatttcaggattggtcctcactctgacttcattcccatcagccacttcaagctcattcctgactcagaccctttgtgcctgctgatccctcctattacggcacctgtcacgtgaaatggtagagcaaaaataggaaatgacattgggtcaacagggcacttggaatgttttgcaaagcacattatctcctgtcattcttacaaccatcatgaagggaatagggtgttggtggtgccagcctagtttaccaaaatgttacaccgtgagtgatgaaaggatcgcactgccatgacttttaaaacaggcttttgctctagttcttacttcagctatccagccatggcgcctgtgattggcatgaattcttctgcatgcattttaatttgttcttattttatagtttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaaggtaagtatttcagcaaaagtggcacactttaagcaacagggaatcactcttcttgggtcacctgtacctgtagctccttgggcttcagtttgattgtagaatctgatgggactggatcccccattagggcttgacctctagctgggccttgtctgttgaggaagttgctctatcaggaaagcagcaccaacagagaaagctaggacttttaggtcccctcgtgcctgacatgcaaaccagatgtgattttggaattctactcccttaggcaggcaagccctgttttttatttctgcttaagctttttagtacagtgagagcgggcatctggggccacagctttctttggcacgtttgttatgttctgtttaccctgtttgtgcctcgggcattgcagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaaccaagcttctgcagattttgtgattcttgggacttttttgacgtaagaaatacttctttatttatgcatattcttcccacagtgatttttccagcattcttctgccatatgcctttagggcttttataaaatagaaaattaggcattctgatatttctttagctgctttgtgtgaaaccatggtgtaaaagcacagctggctgctttttactgcttgtgtagtcacgagtccattgtaatcatcacaattctaaaccaaactaccaataaagaaaacagacatccaccagtaagcaagctctgttaggcttccatgttagtgtagcttctctcccacaagttgtcctcctaggacaagaattatcttacaaactaaactatcatcacactaccttgtatgccagcacctggtaacagtagagatttttatacattaatcttgatctgttttaatcttgatctgttttagtagagatttttatacattaatcttgatctgttttaatcttgatctgttttgtcctagaaaattccatcatacacacatttcctgatatttgggcttagtgcttctaaattgttgcagacacaaaacttaatgattcattcgtagtagtaatctgtagctagttttagggttttgctgaagtcagtgtggggtgtttgtttgaggaaaaagttccaaatatccactagcatagaattttaaactatttttattttaaagttatggcataacatataacataaaaatattttatatacgtttgaaaaatctataccgttcttttttatcatcaaagtttctcaatggccagtagaagcaaaaagacaacaccacctctgatctacgggacataatgttcccaggaaaaaaatcttcaagtgggtgtgagggtgtttctaattcaaaatatgtagatttctccgcatggaagaagtagtaaagattttcttaacatgctcctgtgttcatgcttggagacaagaataagatggtttagaagctttaccctttcttggaacaagtagaatcccggtctgagacctctcaggaatttcagagcttagcagtctggcctggaggtttttcagccttttagtataataaacagtagttgcttcctagagttgagtttttaaggattcacaaaaaggagcctgtacaaaatatacatacagttctttattaaacaactgtaaacacttcactgtaaaaatccataaaactttataaacaaacattttgtaaatagaatctatgctacagtaaaataattaacacaattatttacatgcaatactgacaaatttggcactttttgaaaagaaatgtacaaaacacttgctttaaaagaaatttaaaattataaaaactccgagcattactatcatgcactttgcaaatacctcacaagcacttatggcacagctatcagagagcatcaggctctctggtaatatttatgtaacttttaatgtgcttccataagtttgttgtaaaaccacctggacattgtcaagaataaagtcaaatgccatattccaaaccgattccaccgattgctgcatcagcctaaaggtggggagagaagaaatgtcattaggaattaggaaaggtccttaagactaattattcctttttatatataaaaattgactttggcaaaaaaaaaaaaaagtcctggccaggtgcggtgtggctcatgcctgtaatcccagcactttgggaggccgaggagggcggatcacctgaggtcaggagtttgagaccagcctggccaacatggtaaaaccccgtctctacaaaaaatagaaaaattaggtgggcatggtggcacatgcctataatcccagctacccgggaggctgaggcaggagagtcactggaacccaggaggcagaggctgcagtaagccaagatcctgccactgcactccagcctgggcgacagagtgagactccatctcaaaaaaaataaaatcctagaacactcaaatttttttttattttgttttgagacaagctgtcgatcaggctggagccatgcagtggtgcaatcatggttcaccgcagcctccacctcccaagtaactgggaccacaggtgggcaccaccacccccccagattatttattttttgtatttttcagtagagatggggttatgccattttggccaggctggtctcaaacgatccacccaccccagcctcccgaagtgaagtacaggcgtgagccactgtgcccagcccacttcctatggttttttaatcacatgtaagaccttgagggcaacatatttggaaccttatttgctacttagtcaacatggcaaaataaaggatatcactttctcattaaccctaatgagtacagtttcccagaaagtttaaaacaactcagtacaccctcagccattgtgacatgccattttttcccatttgataaaagtgatgaattactaccttttcatgtattttataactagatccagtttttccaaatctttttcttctattagatcagtacagtatttcacaacttggagaatgtcttcttccattggatctaggaagggggaaaaacttcaaatgaggaccagtctttttgaaggagaaagtcagagatctgcatggataaaggaaaactgcatttctacaactatgtcactaacagctatcaaaggaatgggctttgttacttttcaaagcaagtcccagaatttaaaagatttgggggtagctgctttaagcttatcagagttagagaaatgggttaaatctgcatagtttagtctgtttatgttctcaaatcatgagacgactacatctcagccttgggccatctaacacaggccaagccaacctgaaattgtagttatccattctctgagcaaggtcttcacatcattgaattcaacagctccagctagattgggtgctggaggtctcacacagccagctgggtcagactgcaaactagaaaggcctggcacacctgaagtagaagcagagagttcttcctgttaagaaaacaaaggataaaattgctatattcacacattatccaggtatattaagatctcataaaggtcaaagttaaggaattaccaggggtttctctgcaggaggtccttcatgttttagaaacccatcaattaacttctggggactgccacaggcccctggcagagtttttgcaggactgttaagcagcttgttattcaaaggactctgaatcctttttggtgaaccaatggtttttttcttcttgtttcttttcttttctttcactgctgcctttagatgaagtaaaggattctttggcactaagagcagatggatataagatcctcaacaaaatgatagtatggatagtctggatgacagtattgggttctcttttctcctcccaaatacaacaggctccctagcctacacctcccctcctgccccaagtgagaggcagtgaatggcaatggcccaaagtacaggctctccaattctctctttgctttgccacttactaatttgacctttggcatgttgctcatctatgatgggtagtactaaatgtgggtttgatgtttgtgatgcattttgaaccaacatcctttaatgtattcatctcaaaggacaactagctgaacaagtatttaagacatttgtggtaatgtcctattccaactttttaaaaagtaaaaagtggtgtgtttaaatcctgaaagtacagacacaaatccaactagaaatatgatgatatttactcatactgtatacttcagatattatcccaatatgaagagctcttaatgcaacagcttagactttgcccattatatactgcaataattagacaacagtgactccattactctttgtcttcatttttgttacatgccacttccaaggctcaccagatgcgctggctgactgctggtgagtgctgttctcgccctgcctttgtctttgatcatacgctgctttcagctccctctgaagttcagcaggaagggcagcaaatacctcagggtccacctagtggaaaagacgaggtcaaagtcaaacctgagctaattgtagatggtagctggtttctctttttcacaaaacagactttgttttcaaatctcacttttctgatctgtacgaattcttaacagttccccaatatcaaagctgattaaatcttcaaaatggttagagcaagaataaggaattaagagcaagaataaggaattaagagtactaacttaaagaaacccactacaacagcagaacctgggcaaaatgcactagtagaaaatgggaagcaaaacattgaaacagggactcaggttgttactgtcccccatgcaggattatacatctccgctctgttgtattcaagtgtggccattgatgtgtttgccccagatcagtgtgtttctgtcttagcatgccctcccccgtctcttccctgctgcttcagcgggaggctgctctgtgtctacatcctgcagatgcaggagatggagacaagcccactctcccctcccctcccctcccctccccagtggatgtggtgtcagatacagaggagaaagggaagtgagacaggtcctaagttggagcaggggggtgagaatattgaaactacagcagagggttcccatatttaacttacctgtgaaaatgctggaagggctattaaatttattcctgcgtcactgttcgattcttgaggttctggtatttgcaacaagactgtcccaactggttgtggcaaaattcctgtattacagccatttactggttctttctttttgtcgccatgtgactctgcttgctggacagcacagacttgctctacttgttcccggagatcaggtggaagtgcttctaaaacagactgatccagctataaaatgccaaacatatgagtaggaagttaaagcatgctcagagatgaggtgtttgggagttaacacgccactttaaatttcaatttgaatactgtggataatcaatgtaaggtacagaccatcaagctaggaaagccacctccaaatcagcacatttttggaacgtcttggccttttgtcattgaagcctgaagtactatgtgtagtctggaaagaagtgtatatatactaccagccactatcacatgaccaggtaagtccaaatatactcacagaatgtcctgcaattggggccaacagatatgaatagccttggtgaagctcaaattagatcccaccccagggaggggtgaaggcctgaggcacatgttaaaattctggacaggtaacagtcctgggtcaaaagttcacctttcagatgagagactgcccaaaaatacaaataattctactctgagagcagcacactggaagaaagggtttctagaagctgaattttctctaacttacaggacagaatccactgttcctttgccagggcctacctgtgcatccacatctggccctttggaaacatgcaatcccatcaactgggtggaccaatcttatcttgccaggagtaactaattgtgggtatctgtcgccatacaagcatatcagcattgccctttcccctagttttgcagccagtatttaacatctccttccgcctccttccatgcagggggagcagaggcacaaataaacttgcccaatatagcttaaggtgctaccttactttcaaggaccagcagtatatcacatgtacagcccacacacgctgaattaaaccatccaaatctccagagacctgtttgcaaatactgcaaaaacccttcgacataaggcctctacttcaccactaatcaccaaagctgccttgctgaatacagtaagtctgcatgatgaccactgtcacagacaatggcagtccacaggaggactgcctttcagctatgctttacaacttgcaagagtggcaaatctttgcaaaagcactttcactcaacccaaatattgcttatttagaatccaacatcatgatctacccaaacaagtggcccgttctccctttcttggttaaacggatgaagaaataaaaatgccattttcatttgtaaacttgtatttttgtatttatatttaggagtataaaatgtacttatatttaggactacaaaaatgtacctgggaaggtgacgggacctctatactcaggttaagtctcgactgcacactgacaggagtatgtagaccattccatttccctgaagactcagccttgttagtatcaggactggtcggcagatgtgcaggaaaaggtggcaagaaagtgcaagttctagaagcagatgatatttccagatccacagcagcccgaaatactacaaaaagaaaatatataaaatagcctcttcagatcatcgggcagggcctttaatcctctgtccattacaaataaaaaaactttattactgattcatcataatgaagaatataaatttttaaaatcacataaagctgtgtcaattttaaaaccaactgccgtctttccaaggacataagcagcacctaaaaaagaaccacattgatgaccaccaaccttctttgtgctcctcttcggtggatttcttagctttctgaacttggaagacatcacggacagagtatgacccactaggaaagtggcttgactgaactgatgggcgactgggacatgtggaagggttcagattagttggaaccaactgattcacgtgaatcccaacctagaacccagaataaagagtatgcttctaggaaaactaaagtgaaaatatgaattcagctaagcaaaatcctcagcaaatccttttcactatctcctggatcctgtttctagaataaaggtaaatgaaagtattcaaacagcattctatatgacttattacaaaaacaatttctaaagtagctagtgagtggtcattcatctcaaacttcagagtatccaattctcccaaaatataccaaaagatctttaaaatcagaaaatccaaacaagtggaatactgtattccactgatgttctcgtcaactaaggttttaaattaggataaaaaaaaattaagagaggacagtctacttggaaacttcactatttttatcttttttaaatgaaatacttctcaaaaaatattggcgggagtgatgaacagcaggtacactgcagacccctccataaagtgccattataacagtatttcagggagaaatcacaattacggctggcttagtgactaatctttcaacaaagcccacatcaagccagaacaaccctttacttacatatgcacacataaaactaaacctacaaaggttctttttttttttttttttttttttttttgagacagagcctcactgtgtcactcaggctggagtgcggtggcacgatcttggctcatgcaagctctgcctcttgggttcaagtgattctcctgcctcagcctcccgagtagctgggactatgaggcatgcaccaccacacccggctaatttttgtatttttagtagagatgggggcaagtgcctgtaatcccagcactttgagaggctgaggtgggtggatcacctgaggtcaggagtttgaaaccagcctggccaacatggtgaaacctcatctctaccaaaaatacaaaaaattagctgggcgtggtagcgggtgcctgtacccccagctactcgggaggctgaagaaggagaattgcttgaacccaggaggcggaagttgcagtgagccgatacaacgccattgcactccagcctgggcaacagggcaaaaactgtctcaaaaaaaaaaaaccccacacaaaaatctatggttttgacattttgatgcctcttgcctgtttcaaaggcatcttgatgtgcctgtggtttcactcccttctaggtcatcatacagcagatgcagagtatgtttctgattaaaaaggaacttaaaggtacaaaatttatgtattcatattcctcacagtcatatctacttctaggaaacaagaacagggaagacatgtatattagcccctggttaatcaggggtaccttggaaaagtacagtaagaatctaagaaaattattctaaaatgaaggaggtcaaaatggaggaagtcaagaatttttgtttctcttttccttgtattacaaagcagctaaagacctacatataaagtccctatacaccagcaataacccttttgagagcaagcctcaaaaatgagagatacattacacaaagtcagaatttacaatgttactatatacttacccctctcatatctgatatatttagtttcattgtatgaaacatgtttagcatcgcctttccaattatttttgcattatctgttgcctggtcaagagttacagtcctgtaagtgatagaattaaaaaacaaaagcttcattccatatgtattcactagtactaaagtagtatggaactgtttaaaagagttatagaaaagttgtaaacagttacaaagaagattataaaagtgaatgccatagtctcccttcaaggaagccagaaataccaaattagttacactggcaaccaagggggaaagaaaaattatggaacactagaactttaaggtaaaaaccgtaatggacacttaggtcaactaaaaataagttgagaaatttagaaaaaggtagattttagctaacatatgcacaaataaatacatattttccagctaaagcacaagtgaatggtaaacacaatgttcttgattccaagagaagttttaggttccaagattatgtatgctgaggtatagcaaatattcagaagagaaagataaattctctgtatgttgtttcttgactctcctttcattgtgtttacagtacagccaataaacaattcttagatctttaagaactcttgaaggaggaccaaatggtccatcagcattattaggtctcaaagatgtgctgacctcacccaccatttccttcagagccttttgagcttctctggcatgagcgggctgtcccattgcaaacagaattactaactcagtaacagattaacaaattactaccagttctctttccaaaggaaagttatttcgtgttttggatgatcctttccatgtataatgaacaaatgaagttccaggccattaaacaagaaatattcccagaaaaaattattataaattgaattggattttcccatagaaatgtttaagaagataatcacattacttcatctgcttatagaaataaccactaaaagctgagcacagtggctcacacctgtaatcccaaaacgctgggaggtcaaggcaaaaggattgttcaaggccagcctgggcaacagagcgagatcctgtctctacataaataagtttttaaagtaaataaataaatgaccactatttactatttgagatacatgtgtatcataacaggtaggtaaatataattcaagataaccaactgataaaaaatgtattttataaattatgttctctaattgtaatttataattcctgctttcatggtaacttgggagtttctctgtttaagagcagtcgtctcacgacttagcaatatcatcatatacatgaatgcaccatgtatggttggcatgagctaatctttaatgaaactatacttcatattgtaagtagctttcagtgtcaaaagtctcaaaattttggtttcacagatgaaatacagtgcaatataaaatgacatgtaaaaccacacatcttcatattggtcacgaatcttacatgaagtttaatattaagtagttggccctgacataaaagacgagtgtttcagaccgggcacattggctcatgcctgtaatcccaacactatgggaggctgcggtgggcggatcatttgaagtcaggagttcaagatcagccttgccaacatagtgaaaccctatctctactgaaaatacaaaaattcgctgggcatggtggcatgccccataatcccagctacccaacaggctgagacaggaggattgcttgaacccaggaggtagaagttgcaatgagccgagatcgcaccactgccctcaggcctgggtgacagagccagactctgtctcaaaacaaacaaccccccccccccccaaaaaaaacagcgtttttaaatgcttttaccagttttcagacattacagtgattcattcatctttttaccaattaaatgtatacacctatgtaaatgaagttgctctccttcaccatcatttttctagctactatagtctgcctttgtgtatcatttttttgagacagaatgttgctctgttgcccaggcaggagtgcactggcgcgatctcagctcactgcaacctctgcctcctgggttcaagcaatcctcctgccccagcctcctgagtagctgggactacaggcgaatgccaccatgtccggctaatttttgtacttttagtggaaatggagtttcaccatgttggccaggctggtctcaaattcctggcctcaagtgatccagctgcctcagcctcccaaagtgctgggattacaggtatgagccaccacacctggcctgtatcattgtttttaagaactacattgaaattttcctcaggaaaaaagtttcaccaagtcccgaaactatagcagtccctttggtctgcagccttgccctttctttctgtccatgcagtaaagttaacagcccaaagatgccaagcaaaggctgccaaggtcagcaatgccgtcaaaccaacctcctgtgtgtgggcctcgctgaaaccaagtgcattaacctaagctgaatgccttgggctgatgcctgcttctacagaataccagattaacgggtttacaggtctttattcaaactcctccttggttttcttcattttctattacttacaacaacctgtactgaaatataattaccaatatcatttctgaggtgagcttacctggcaatgttatcacaaattccatggcctccaaattttgcagtttctacaggagccccaggctttcgtaccatgattttgagagttagacgtttacccttcatgccagtggcttctagtcttctttgaatttcttctgaaagactcagaagaaaagcttctgcctcttttggctatggaaagacaaacgtggagaaactaccattccactttcctatatacctaataattgttctcaagtattttaactttgaatattaaacatgttggttactcactatcacgctcagcatctattaaaaagaaacgtggccaggcgcggtggctcacacctgtaatcccagcactttgagaggccgaggctggtggattcgtctgaggtcaggagttcgagaccagcctggccaacgtggtgaaacctcatctctactaaaaatgcaaaaattagcctggcgtggtggcgggtgcctgtaatcgcagctactcaggaggctgaggtaggagaatcgcttgaacccaggagacggaggttgcagtgagctgagatcatgccactgcattccagcctgggcgacagagggagactccgtctcaaaaaagtaaaactacaacaacaaaaactgtttggtataccctcaactattaaatacaaatacccaccttcccaacaaagtgaaagtaatgagtacttttaaaagatatttttcctttctttccttttttttttttttgagacagtctcattcttgtcccccaggctgaagtgcaatagcatgatctcggctcactgcaacctccgcctcccaggttcaagtgattctccttcctcagcctcccgagtagctaggattgcaggcgcctgccacaatgtctggctaatttttttgtatttttagtagagacggggtttcaccatgttggccaggctggtctccaactcctgacctcaggtgatcggcctgcctcagcctcccaaagtgctgggattacaggtgtgagccaccgcatagggcccctttctttcttttctatgccatcactgacttgtcgaaaattcttttgtaactatgttaataagttctgctaataaaatgtgtgttccaacactgtgcttacagcccaaacatcatctatctccatgcctaaggaaacaaaactcctgaggtccacagtgtaggcacagagggtaattaactcatcacatttcaaatccttatgatatggtgttgtttgtacatacaaattcaagacatatccagccgggcgcagtggctcacatctgtaatcccagcactttaggaggctgaggcgggcagatcacaaggtcaggagtttgagaccagcctggccaacacggtgaaaccacgtctctactaaaagtacaaaaaattagccgggcgtggtggcgggtgcctgtaatcccagctacttgggaggctgaggcaggagaatctcttgaatctgggaaacggaggttgcagtgagccgagactgcgccactgcactccaccctgggcaacaaagtgagactccaccctgggcaacaaagtgagactccatctcaaaaaaaaaaaaaaaaaaaaaaaaacatatccaaatccataatctgaaggaaaatggaaactactcagccatctgtgctgcagctttccaaaagcttgcataaggaggggtttgctgaaacttaattttaactacagcttaaaaaatatttcaacattaaaaatatttttctcatcttttttattttttcactgttaattagaataattataatctcaagttctctaataactggcctccaaagcataatcttttagtatatttccccaagagctaagtttcctcagtctcagtcttatctggggctacaccttaccacacagtgccttaaaaggccttcttaaggctctggggatacaacagttttaagacttaatttcaagcattgagggtctaatggtttagttgtagaggtaggactatgtaaaaatataaagagcaacagatggcaaaatctgttcaatgatcagtacctgagtaaaccttattccatagttgatctcagctgaaacagattttctttccttttcagttcgaactggtctatcatccaagccacggcagaacctataaagcatctgacctgttttgggaccaaattctttttggagttttgccatggtcatatactgcaagtctccacaagttttaattcccaaagatgccaacttagattccattgaatgtccaactcctaggaaagggaatatagttaagtatgcagaataagctactaataacaagtttattaacacaaaatacccaccatttatgcacaaaacaactagtttaaaataatctttaaagtctttaggcaacataactgaagcatccacaggctgaagaattttttggtgcaaaatcatgctagtagatgtatttctagactctacttctcaatttggactccacatatagatgaaccagaaacttttaaaatatgtataactcaagttatcaaaaatgtcactttctttattagtgaataataccaagatatgtatcttagtcacaaaatcaactaaggaatcaactgtcatttaaacaagtctatagtgtgacttacagacatactaaccaactcacgaaatgtaagggatctattatgatttcggtcatcaccaaatctcacagtggtatcagccacattttttcagtgaaaaacagaacaagaattcacaaaatgggccaaagtccagaaatgttacatgctatcacacataccactgacctgaagatgaaggaccctaaccaaaccaactggtggttggggtagaagacagactttttttttaatcaaaaggatgatctctctgaagagatatgaactctcctacagctgggccagcaggcagcagtccctatgtcctattctgcaagatgtaacgtttgagccccacctaaaggatactgattaattctgttgctctaagttggagtcttggttttcttcaatttgccctaaatgctttaaaaaggtccacaaatttgggaaagaggtttggagtaactgagggaaactataatgcttattaaaatggttccacaccatcaagtaaaaattttccatcaatgaggaaaagacagcgttgtgtttctggtcttctgtaggaacttatcaaaagagaactcaggctgggtgtggtggctcacacctgtaatcccaatactttgggaggccaacagtctgagtttgaggacaacatgggcaactgaggtagaccgtctctataaaatagaaaaaagaattagctgggtgtggtggtgcgctcctgtagtcccagctacttgggaggctgagttggaaagatcccttgagcccgagagtttgaggctgtagtaagctatgaacctgccattccattccagcctaggtgacagaacaagaccctgtgtttaaaaaagagagctcagagtgaagtctgctaacttctgttcatagctcccatcctcctgagtggtcttcagtagcagaaaaactatctagtccaagttctgccaggaaaacctctggaaccagtatataacacaaggttaggaagtcatcaatgtgggtcagacaagtttaaacccagacactttattccttaatggaagtgagatgaaggcgttaagcgtgctcgttcacaattgtgccattttaaagtccaagccagaacaaagggcaagtaaataccaaagaccccgagttaacaatttaaaaaaaaaaaaaaattcctccagagaagtaccattcaccaaaaggtaaaattttaagtgaaacctaagtgcttttcaaaatggggaggagaaacacaagggaatagacaaattacatacttgggtttgtcaaaggtagacactttgcacagctatttgcttttaagaaagacttttttcttcaatttgctctttttgttatttcttttttgtcataagacttcttaacatcagggaagactttgtgtctctcttttgtccctcccactattgcctcacttcccactcccataatctgaccatgatctttccgttacagttctggggaacaaatctgttctcagggacttccaagattagcaagagacaatcatcatcctgggttgtgttagtgtgtccatgtgttggggtggaaaccccatagtttaaaattttagagtatcttgagtataccacaacaaattatgcactacaggtgcaaaggaaaggctatattaaacatcaccaagttaaccgtaatcaatctaatctaagtggacatccctctatgaaagaagcacagttcttctccatgcaggctcatctgatggaatgaaatggcctgaaccggaggtgggggagggaggcagggcatgtggtgtacctccaactcctattgagtgggggtgggaaaattaaacttggagccaggaccaaaaccttgaagagggctgctagttttaactaaatacgtcaattaagtaggtgtttataagggaaagatggcaactctatggacaaagtaaggggggctccgggcccaaagagtgcagccacctattaaggaaaaggtgaaggaaaatatgctcttttagaatcaaatctcaacgaagagagagtcaaggaggctcctggtcaagcaactgggacaaagacttggcatctgtccttgaaggggaactattaccctaggttaaaagtggccaataatgtcccctccttggcatccagaacttggctatccaatacagacatagaggagtaaacttcaaagaataaagttttcaccatctacaggagtgctgttcaactgaactttctgcagtgatggaaatgttctcgtctgctatccaatacaggagaaccttgctccatgtgaccactgagcacttgccatgtggccagggcagtgaggaactgaactggtagttttatttaactttaatttaactcatattgtactagcttcacttggctacgtagctactgtattagtgcagactttatgaatgcctacatgatcatggtggttctctgaaaatgggatagagagggaatccatatgctagatgcacaaacctagcaaaggctgaatgaggtgcagagggcccttcattgaagagtgcatgcgcaggtaaaaagccctgcaaagatccagagaaaaagtagaaatggttcttcaaactgtaatagtcgttggggtcaatcctttctttcattaggtaaccggatcatattaagaaacgtatttattagtgtaatacacaattattattctgtggagtctcctaaagcaaaaacttactattgtgtttttccttcttatgtagttattctaattgtttattactgtgcgcagcacgtatgtggtcactaaacatttatgggtacaagggactaaagaggttggagatggggcaagttaccactgaatttctcctggttatggttagagagccaagttcctccaaagcgtgttccacaagatataaataggtactgtatatttatcaccaaatatctttgagaaattactagtctttaacaaagataaataggtttcttttctaaaataattcccaggactttcactgtacaaacccctccaccacagaaggttccctctcctatatgaaacccctttttaaaggaacagcttataatctgtggaacacacttcaggacaggagtaacaatggagaagggagatattttatagacctgaaatgttctataacagtcaggttaaggatttggggattttatgaaaaccacatgaaccactgtgagcaatacagaacctggctctgaagaagagaaggccaactctgctgccctatctttcaaatctcccttaggaaattcaaggctgtgcctcagcttggccaggacatgtaacttcacacttgcccttcaagaaataaagtctcactgggcacggtggctcatgcctataatcccagcactttgggaggccgaggcgggcggatcatgaggtcaggagaccgagacagaggtgaaactccatctctactaaaaatacaaaaaattagccggctgtgtggtgggtgcctgtagtcccagctactcgggaggctgaggcaggagaatggcgtgaacccagaaggcagagcttgcagtgagccgagatcgcaccattgcactctagcctgggcaacagagcaagactccatctcaaaaaaaaaaaaaaaaaaaaagaaataaagtctttccagccaggaagcaaatgaaggtgaatggtaggattactaggtcaagtagctaaaacgtccctatttctattaaaacaaagaaaactacaaaaagggttcgatttaaagatggtgttttggactaaactgtgtcttccccaaatttatatgctgaagtcctgaccccagtacttcaccatgtgactgtatttgtttttgttttgtttttttcaacacagtctcactctgtcacccatgctggagtgcagtggtgcgatcttggctcgctgcaacctctgcctctcgggctcaagcgattcttgtgcctcagcctcctgagtagctgggactacaggcatgtgccacctacccccagctaattttttttgtagttctagtagagacagggtttcaccatgttggccaggctggtcttgaactcctggcctcaaatgatccatctgcctcggcctcccacagtgctgggattacaggtgtgagtcaccatgcccggccacagtgtgactgtatttggacacagaatctttaaagggtaattaagataaaacaaggtcatattgatgagcctaatccaacatgactggtatcctcacaagaagagatcaggacggagacatgcatatggggaaggccatgtgaagacacagggagaggagggtcacctacaagccaagcagaggcttcagaaagagccaaccctgctgacaccttgatcttgaacttccagcctccagaactgtgagacaacgcatttctgttgtttatgcaccccagtctgtggtactttgttatggcacccctagaaaactaatacagatggctagtgtaataaacttaaaactcaaattttacatgcaactttaaatataccagttccttcttatataaaacttcagtaagatttcttattaaaaatgtttaaactgtgttgtctactacagtaatttgctagtttgattttataaagtattctcaaattaaatgtgaaactaaccatcaaaaatgtcatattacacatttctgacactaatacatcgttttaagttatatactacgggggtcaggaagctttaaaactaacctaccataaaatgccatttctgtcgtttaatatttatggcctgttaacagaaacttctaagttagttcggacatacttttattaggcttaaaaataggcatctaaaaatgccactaaatctacttttaacaaatgaattttaaaactttcactataaatgaagatggaagactttacaaagctgacagaggcactttataataaataggtaactacacaaaaatatgaaataactgaacatcctgccccttaggtgagaaaggttaagatggaaggtttttttccatgagtggagttaattgaaaacacaatccttctttacgtttcctttttcctaatacagctcacacacattctatttatacttttaaaagtacttgtttaataaactcagaaaactgtcgctagtcctgcagcatgacataggagaatcgaagctcaaaacttttatctttagcccaggagtaaactatttcaataatcatttatttaaaggactgaaagtcaatttcatcatcctcccttttaacattgtttcttagaatcttgctacttgagaaatacctaaagtaaaactgaatagaagcaaaacaaaaatgtaacattaaggtcctgacaaatcattttaggggatatttaatgcagaattccaaattttgtttttcatggcactcaataagacttaaaaatttttatattcatgtctgggcaaaaagaggtctcacagttctatattatagatatgaaaagtacttgtaatgcctgtaataaaagtattgttaaaatatttctatttacctggtagattggtcactagctggcctctgataaaatcatctacttcttctggttttaggtggtactgcccatctggttttgcttttctagttgccattctagccaggagaatattagaacctattaaaaaaaaaagtcatccaagaaatagtcacaattattttttaaatttctcaacaaagatctcttcatacaggttatccatcaagtttctaaaaacaatgaaaataaattttgattatttcaaataaggtgtagaattttgctaagtatttagattataaccaacagagtacctggacagaggtttctctttgctctaacgcaagtgccacttcagcatctaaccagaagcaggaatagagaaagcagtcctgattttttttttttttttttttttgggggatggaggctcactctgttgcccaagctggagtgtagtggttgtgatctcagctcactgcaagttccgcctcctgggctccagccattctcctgcctcagcctcccgagtagctgggactacaggcgcccaccaccatgcccggctaatttttctgtatttttacagacggggtttcaccatgttagccaggatggtctcgatctcctgacctcatgatccacccgcctcagcctcccaaagtgctgggactacaggaatgagccaccgtgcccaatcagcagtcctgatcttcagagtgggtgtctgtaggaattgaaggccatgatcaaagagtagttcatgttcccaaccacaggagacagaggaggtagggaaatgacaataaaaagtgcgcgactggactggggaaaccagaaagcccaaagcagcagtgggaactgagggtagaagagtcctcaaaacacagagacaggcagtgaggttcacggtgtaggtgtgggcaggggccacagaagcagtggaggaaaagggcaccaagccctgagaaggggcagggatctgcagagctcagctgctaggtgggcttctccgtgaataataaaatctccaaagggaagacttatattgaggacatatcttggttttatagaagacttatataaacagagattcacgaacagggaaagttctgggaagtcacaccaaaatgataaaagtagtgagttcaggggaggggaaaggcactgaggagtggaaatataaagtgggactttggcattacatatgcttgaacttaaaagaatggattcacatgatcacttataaatgaaaattaaggacaattaaaaacaaaaaaataaaattgtgcctgacaatggaatatagaattcctaagtgaaatgttaccaatgtctgtgggccaacatcagggggtaaaaggtaggctagccagtagctgtaggaatgctgggaatgtattaatcatactttttattttctgtatctcgcagtgttttgaaatcttaaaaatcctgctggctggggagagactgccctcccagggctggctaattcctaaagacagtaaacctcttacctggaagcacacttgtcatatgcaacctaaccacctcctgccctaaattgtcccagggccagctaccaggcaactagggaccacccctatagcccagagcccaccagaattactcaaactagccactcctaaagtgtttcctcagccctgccttgcctttctgaaaaaaaccctaacaaaggctctggagcctaggcgctccgtctgccactccttcagcttctgtctcctaaccaccctggtgcttccccagtagtcctgtgtagcacggtgtgcccctcctctcgggaaatggaagtaacaaattcttctttcaatggcattagcctctctgcatcatcactcagtcattagtaaatttcatgggtacaaaggagacagggaactttggaagaagaagggtttttggatgaagatggaggaataatggttgaaagtgacaatggcaagctaagacagttaactttaccttccaagcctgtggtatactgagtatggcagggacaaactggctctagtaacagaatggcaagaaaaggggtatcttgccagaaggtaatgagtgggttaagaaaggaagaggtgactcagggaagcttaagtatgaaagagttccagaggacacggctggaagaatcaacaaaaaagcagggtaagtgctgggagcagctgtggaaacaaagtacaaggtttaaagacagcatggatggagatggaggagagactggacagttactgagagcacttggagtcagggtgacttctagaactgagtgaagacaggaatagctccatgtgccgggaggctgaagtgcagagagtaacaagactcagacttaacacgcaactctaaacccataccaccacctagctttaaatacggtttccgttcacttttgggaaaaaaaaaactgtttacaaatgttgaatgaaaccttcccaattttttaagaataagtaagaaatattctaacttatttattgcgaagattatcaaccatttacttatatttccagcacttatctcgtgtgtcacacaattgtaagcaatgctaaaaacggttttacaagtgagaggaagctaataaaaagaaaaactccataaaattaactgatattcaagaatctcaaagcaactcttttgagtacaagataagctagatactaaccaattccaacagaggcagcacatttcgtctggtctttgatttccatacgaacagcatttgcaaattcatcaggagtaagtttggtctctgcaaggatttcggtaatgtctaccagcgcttcatcacaactgacagcttcaatgttatgagtgtagctatcaacacagagcaaaggcaacgaatcacagccacagccaccatctggtagacccaatgttgcaaaatagtcttcttatcctctcttttttctatttcctcacaaagcattttaaatgaattggctgaagtaccattttagtcacccaacttttaactgcaaagttaattagtgtgttctctttctccttattaactaccaaaatacagcatattggataggaaaatgtttgaggagtaaaataaccaacaaaaaaaatttaaacacaaaaaaacaaaaacacagcataaattattatttcagtttctctatactgacaatacttctataaacctttgaagagttgaaaaccggtgggtgaatttgaactgtcaaaacatttaatctaatggtttatgagaatcctttaaggaacagaaaaattagacaaatcagtaattgctactctcctaaaaccaaaatatcacagttaaattccactcactgtagcaggcctagaatacagaaggaaaaagtggccagtcatcccaactgcttgtctgagaatagttatctacactctctgcatgtggacatactttttaaaaaatcatctcataggatctatccacaaaaaggatttgttttaattagagaaaagaaaaaggaagacaagagttgctatgtggcccccatgctaatacgaggactaagaaatcacaaaatagaactggaccagaaatgggaggaaactttcccaagaggcctcaggatcaaaactatgtctttcataatccacttggtaatgtagactaggagggcggtcctcatctctcacctacaccttactgtaggtaggttacaatcagattaagatctctattaaagaaataatctattaaagaaataagtatgttttgtttaggcttaaagtatgacatttttaagaacagaagggtatatctggtatgaggtattttgcttcagagtgaaagctgccctgagacagggagaatatgaagctgagataggatttcccaagggtggtagaagaacactactgtggatatttttcccctaagaatagaaacatgccactgaaactgtctccagccttctactgggaccgtgtgcatgtgactgtgtaggagtataggtcacagctctctctcacatcctcataacctcaggcacaggctgatgcttgctctagggcttcaatacccaggacacaggagcaccacagtactgacctcagtcacccatccctatctagccctcgtttggatgctaccactgacttcctcctttcaaagaggatttaaagcacgttccacttgacaataccaacattcctgtatttgggatttatttatttagttacccaacttataactggaaagttaattagtgtgttctctttgtgttaatagaatagctataataagtgtcttatcattcagcactcactcctacataatgacgccaggaaataatcagttccttcacattttctctctctctcctactaaagcaagctcccacaagggcaaggattagatattcccttctggactagcagcatctagcagtcacctgtacttagcagatactggtgttcaaattaacgcataaaaaggaagaggcagaggtgaaaacagaggcaagaagtctatctcttggaacattaatactgcccaggagttgacaaaccttggcctaacatccagtaaatgcatttttactggaactacaccaagcccattcatatacattccccgtggctgctttccattcacaacgcagaactgagaacttctgttgagtgacagaaactttatctggctcccttcagaaaactatgctgacccctggtttacagcataataggctggttatacttttaagaaatttgagtcctgagttaatatggaatatatctacacttttaaatatttttaaatacatctacaattttaaatatttttaaaattaatcaccttttctcaagccaactcatcaaccattttgaaactattattaaagacccacttttatgaaaactaacttttggcatatccaatgattttaagaagataaaggttttaaagtgtctccacttgttatcaacccatcagttctaattttgaacaaaactataattaaaatgaaataaaagagaaaaaccaggttaaaaaattccatccttcatctatctggctccatgggaagaaaaccagaaccacagactagaagtaatataagcaaataatcagatcttacatcaaccaaggaagcacatgaacaattttggcaatacaaaactatcctttgagattgagctacctggaaattgcccaaagaaaggtctcaaactgggatgctgaggagtggttcctggaagataaaattctaacaaaagtgatcctgacaatcctaaagaaaacttgaactgtctttactattagctaaaagaaggaaaacacagacacaaaatgacagtttgatacactgtaccttgccaatgtttcatacaatgtttgtgcgacttccttatatgcatgaaaatcgtatggaacagcttgaagattaggacatagttgtttagcatgcccaaaaaacattccgttcttaatgccaagttgcctagagcgagaacaaaacacaatggaggttattctaggaagttttcaactcaaatatttatcaaatatgttgatatctccccatgccactaatttataatttccacttaactccattctcattagggattaaagataggcattaaaatttacagccttgttttcccccaaaagtcacaactgtctgaatagtgtaaatgacacatgtagatgtgccaactatgtcattaaaataccaggtttggctcttgtatctgaagctttctcctaaaactcatacctctggcccctttgcagagatgccagcatgccatatgctggtgatatcacaaccaccacagagcaggaatatgctgtcaaaaagaggttttcttcccctaatacaaggcacagtttggccagggttcatcccccaaagacaaagaatataaacaaaagaactacacaaaacagtgctatgtgacaaacagacaaaatgtactcatcctattaccacccaattcccaattgaccaattccatgctcctgaagtggctccacagtggttgagatgccaacagcattgtacatggtaggacatcactctgggcaggagccagggttccagaactttgagggacctaattgaaaatggtaaattttaaatctgtgtgtctcagtgccccacattacctttgacatttggagcattcaccacaaaactataattatggaattatacataattagtaaaattctattttatcactctgtaaagaatcaagaaaaaaaattatagtaaaaacaagcaaaataataaagcaatgtttcaccaaattacatattatataataggataatggttattctatatatatgttcaataaatatttactacacagcatggagacgtgccttgttttaagaaacgtatatacaaacagttgccaattactcataggcctctggcaccctcccaacatccagaccatgagagccaagaagaaagagtcctccaagttactcagcagtagatgcaaaatcacatgcatttttatgtttataaaaatagtaatattataaatggtctcagtgctaagtccctagtagataagaaatacctaagaggaaggaaaatgacagagttgtaaagaaaacaattcttgatgtgtcgaggacttagcgaggtgctgggtataggatggcaaataaagcaaactccatgacctccatggggacaaccttgcacttgcctagaaaaggatgacctatggtcaacaggctttgtccactaatgaagaaagtagatacctaacagtttagacatatatgtagaaacataaaatagtttagaaactttatcagaaagcagaaaaaaggtctggtgttgaaaagggtaaatttcaggtaataattatgccagatatatagattcagcatgtaaaagctgagtttacaaattaaagataacacattttttaaaaatgtgtttataaggccgggcacagtggctcatgcctgtaatcccagcactttgggaggccgaggcaggcagatcacctgagagggggagttcgagaccaccctgaccagcatggagaaaccctgtctctactaaaaattaaaaattagcgagaagtggtggcgcatgcctgtaatcccagctacttgggaggctgaggcaggataatcgcttgaacctggagggtggaggttgcagtgagccgagatcgcgccattacactccagcctgggcaacaagagcgaaactccatctcaaaaaaagaaacccaaatatgtttatagtccaggcgcggtggtacacatctgtaatcccagcactttgggaggccgaggtggatggatcacctgaggtcaggagttgagaccagcctggccaacatggtgaaaccctgtctctactaaaaatacaaaaaaattagccgggcatggtggcacactcctgcaatcccagctactcgggaggctgaggcaggagaatcgcttgaacctgggaggtggaggttgcagcgagccaagatcgtgccattgcacctcagcctgggcaacaagagcgaaattctatctcaaaaaaaaaaaaaaaatgtgtttataatccctataaatatcatgttcttatatttacaatattttcattttcaaaacattaatttacacaaaaattttccgaagcacattacttagtaaaatatagtacatctacttatgtactcatgtaaaatgtacccagagaaaactgtttaagagccattagacactataaggaagttacaaacaaaaaacgaaaacctttttcctttggtttgccttaggtttgccatactaagggaagccaaataccttgagttgatggctgggaaatgagctttgttccatagaaaataaatgagtaaagacaattacaaaaaagtccaaagtgtctcaaagtgtctcttcattaccgtgactcatctattacaactaaaatcccatacaggataaattaccaaaacttcgttaagtgtatgctgcaaaaacagcttattcctacatttaaagcacagaggacatattctgtctggcaatatgctttgttcagacagttgtatttggtgttggattcaacaatattaaaaaattgctggccgggtgcggtggctcactcctgtaatcccagcacttttgggaggccaaggcgagcgggtcacgaggtcaggagttcaagaccagcctggccaacatggtgaaaccccatctctactaaaaatacaaaaattagccaggcgtggtggcgggagcagtaatcccagctactcgggaggctgaggcaggagaacggcttcaacctgggaggcaggggttgcagtgagccgagatagcaccactgcactccagcctgggcaaaagagcaagacttcatctctgggggaaaaaaattgccatcaaaccactgtcactgtccattctacatactaaaatacatccataaagtaagaaaggtagtgggtccttacaaaagcacaagaaaatggggtttagaaattatatgactttaaagatctgtgattctaggatatctgtgtatcgttacctattcatgtacaatctaccttctcactgattccatataaagtttgctctctactgtaagtataggccaactactaacagcagtgcaaactgtgacccacatatacacattctactttgtatttctaccatttcatattcacattctatcctttgctggccccattattaagctatgtatagtgaaaactcaccagtgcatcaaactgagcagatcatccccacaatctagtccccactccaaactcagtaacatttctcttatgcaaattgttaaaaaaattttcctcagataaggaaaatataacctgttggatggccacaaaacaagtatccagaaactattttctagaaactttcactaggaatagccttctagaaaacagaaaatcacaattaagggacaaaaatcttacggctgcattttttttttcttcaagttaaattcattttcatcactttatgtatcttcttaaacatctgcacttaagtggcacttgaatggctcactatatagtattctgtcctcatatagtcaccccaattattttgcaaggcatgaagcttgaccaaatttataaaggtaaatttatatttaccgtgggtaaatataaatgcaccatccaaacacccaacagaagcctagtgcctacacacaattgtggctcctggagtccaaagccaccagagctggtgacactttcacctggaggcagccctgctccccagccagcattcatcttggtgggggactgggtatgaaggtataaagggagagaccctgcagaggcagccttagcaagggtaaacggagctcgcattttaccaactagcgaaattcaaggactgggaatatttctgggcttcatcacaccctccagatactgcacataactgtctagccatctgaagtccaggccaccattcattaacttagtagagaaaaagagactagcctactgagcacaacataaactcagctctagagtgcctgtggtaataaaaagcagtataacaattcaaaacgtatttgtatttgacttaattatcatttaaagtaagtttcaattccttggccacagcatcaagtgacaatgaaaaccattaaaacataattctgttaatgagaaaggcaaagttagctggggaggaaaagtttggcatgtcatgaatggaaaacagtttaaaatataagcatgcacgtttgaacttaatgctttttaacttaaatatactttaaataaaataattagcaaatttaaaaaaaactattatgattagacgatgctgagctcaaatattttttcttcagattagatgcctgaatagccacaactctgaatcaagactaaaaagatgtaactaggccaggcacagtggctcacgcctgtaatcccagcactttgggaggctgaggcggatggatcacgaggtcagttagccatcctggctaacacggtgaaatcctgcctctactaaaaaaatacaaaaaaattagccgggtgtggtggcgagcacctgtagtcccagctactcgggaggctgaggcaggagaatggcatgaacctgggaggtggagcttgcagtgagccaagatggtgccactgcactccagcctgggtgacagagcgagactccgtctcaaaaaaaaaaaaaaaaaaaaagatgtaactgatctaagactctgtttcgatttgaaattattgaatactttaacacttgccagcaatgtgtaagggcttgctgtgtgatataggtaaaaatgtctgtgtttggttgacaaggaaaaaaaaatgaagacttctctttttaattattactccctctacttttacaactattccaattatttcaaaacggttttttaaattatgaggaagatatatatatatgagtgtgtgtgtgtttcttcctatactgaaacagccaattataattatggtttcagatcactataagataaagacctatacaaaaagttggtgctaacaagttgacaacactcttaacacttttaagtgaagagatattaagaatgccaataattcaattatttacttataattgcataggcaaatgggttttaacactaaaaaaactgagtatcaggaagtatggattacaagattttttcttagcaataaaaacaaaagattagagggaataaatattaaagtcctcttccattaaaaaaaaatctaattcttttatttcactcttcaaaagacagtaaaaacgatgatccccaatttcttttggttcctactacatgacctattggttctcatcagggaactagtaagctgtttgtttaaagttatctagcactggtggggggttgtggggggcatagatgagatgattaaggctaaaacctcataacacgtctgtaacatttaaatccacttcaaaagattatagttcaagaaattatataaaaataattaaccaaattattcattaagaattgtaacacacaacttctacatacctggcctcataactacaagatgcaatttcagcccttgacaaaacagaatcaattccatttgcttgcgcagaatctggattctcccacaatgatgaatctggtatatctgctttaaaaataaaaaaaaattaatggttatatgttataaactgattttccctcactttttcaagaaatttgttttccattactttcatataaaaatgttcagtaaattccaaatacagttatctctattggtattatctccttatctaataaaagaaaactctaaaatggttcgcttccattatattcttcatcagcagataaaaacttataataaattcaaagtgtcctgggaggtttgttttttttttaaatacaccagaagataaatataaaatatcctataacacacagtccctggaggtggacatggatgagaagtgatcagggagatgaactccctcttataaccttaaaaggactgtacagctctcggtagtggggaaaagttaacgaaaaatataaatttctctgaatattctttgctgtttcctaaaagaactatctgtaaaacttaaagctaactaacgggtacaacaaacatgaaattcctaccatctatctgatcaaacaataatttagtaggtcacaaaacatgaagaggtttcatcctaaattcaagctttttcttttgtacacatgtcacattatcccccgctacaggtaattgtattttggtttaataatgcatgttcaattaaaaacattcaagtgtgatcagagtatcgatgctttagagaacacaactggagcctagtgtggcttaccaacatctcttaatatccaaaccaaatttacaactttacacaagaaaacaaaaccacacactctggagagcctactggctgcatgccactttacttcctttgccacctttagcttcactagtaattgagaaataaattaaaacacaacttcatcataggtctcttgggatactactattaggttccaggaagagtatgctgtaaaaaaaaaaatcacattctaaaaccacaacctcagccacatctctactattataaacaaaagtaccatgagtaaaacaaacccaaaatatatcacttcagctattccagacaaatctattttgagtgcactgtaacaacacataactaagaaacccagcatttctcttttgtttatttcagactcactgttctgtgaagtcagccacgttaatgcaccaccaggaaaactggcaaagtctctggcttcatgggcttaaacaactcttcctggtttgaccaataatcatcagcatctttcatctaactatgcaacccatacaagcatttctggatttcggcaaccatatatacacagcataaatgcaaatcaaactgactaacatctcgggtcaaatcctacttgcttcaaaacagcagagtgtgtaatgtgagctagtttctgacatatgaataacgtatgctagctatactattacaaattaaagacagaatcccaagcagattacccagtgtttctggagggttttaaaagggtaaatataaattttaatagtccattcatctaagctgaaaaactgtaagaatttcaggactgtcagtatcacacttcaacagagggtgctactagaccccaaaaaaaggagtgctgaagcttgaacagccacaaccaactgtctttccaaggtgtaaccatgagttatgccttacaagttggagaattacctgactttggtatctgaagggctagttatctaagatattgtcttgaaaataacagaaaacttatgcttgaggagagaacagtctctgtggtccatgcgcccccagtgccctggcctgagaggcagcaccatcgtgttcctctccattgggctggctgacctgttccacagtgcagcagagtgcgtgggtccctccacgagcggagtgagttgcttcatgtgagattcagggaaatgcagggacacactgtcctcactggagggcaaagtagagaactgctcatcaaaacttgacaaactagacgggcacatggagaatgtggaggaacggttggagaaatcagaggccaggacccaagtctgtgaaaaagaaatcgctgagaataaatctatgactaatacgatttttaaaactgttgttctttagaatgaaaactgaagttgtcgatgggatagaaaacatctgtatcctggaaatccaggaaggggtaaaaggccccaaccatgaaatttggagcataaattgttccaaacaatgagatcatcaatgagaagtgtgactactgagtactgctcaggaagcagcctccaaaagaagtcatggatggatgagataccctggttgcacggggctaattaaagagtttttggatacgacaactaagaaactaaagtttcaaaaaggactaaggatgctatttgtcctaatactttgtctagacatataagccaaacattagaactgatcttttttttttcaaagctagtgcacagaagccaaagattctaattcctaaaccgatcctcaatatttttatatttggtgccatgtctgataatgacccagagaaagaaagatcagggaataacaagcaaagaggaacaaaagcactgaaaaaagttctgagcacaagcttagttgtaatcaaactttataataaaggataatctattcattttatatgtagcaaatattctggtgagctcctaatacgtgaaaaggcttaggatataaaagtaaatgacatcaagttaaagtaagagtataaaatacaaactgtcatataatctttttctagtgacgggacaatctccttttgacaattttcaatggcaagtgaaatttaaatatttctcctaatattaccttctggtttaccacccacatttagatgtgaaggggatgtgattatagaaggtcattaaaatgttataaaaattaggtgactaaactgatgaagacaagtaaccaatgacagtactgtgttaataagccatttatagtaagattgtaacagaagaaaagacaaaagaggactagctctctgctactcctaaggaatgtgagcttgtcaaggttaaaattttaaatgtaggctgccgataaaaggacgtgtgtaacaagactacctaccagagagactctgagcactgaagatgctactgcaagtatatacatggtggtttttcttctttcagcattctttagtatttcataaatgcctaatatatgacaagtattgtgtacttccttaagctatttcttattttctagaacttaagatttcatctgtttaatagcacacagaaaatacaaaaagaaaaaccaacctaccacaaaaaccatactaccaatacctaagaaactacctataccataatacaagtaaatctcaacaagttcagtaacagctactccacatctactcatgacacacaaaattctagaatctcaaaaatctctgaaaagatttaaagaccaagaaaacctttataaaacttggaaataaatgtacacacaaagcataaatatgtatctgcaattatgttatttcatacttaagaccacataaacagatgatcaaaaccaacaaaaagactataatcccaaaaaaggtcctcagagatgttcgctggctttccttttgccttaatttcattggagtcattgtgacaagcccaacgttttataactgacaagggcactgaaataactgcaataaaactaaactgcatgctttccatttcactgtatatctaacttctgactactttctgggtaatatatttctgagaaactaattttaaaaattctctttggctttgcaaaacaaccatgagaaaactaatcagttaccaaaaaaaatttaatttctaagaaaacatttctcagtgaatttactcaggggaaaaaagcaatagacacatgaaaatcttaataagtattatgactagtacaacttatgattttgcttattaatatccaaaattaaaaagtcaagagaggcaacaaggttatttctcataacaggttcactaaagcatatggagaatgattactggtgtttacttttaattccaataaattaaaagttctactgtttgttattctacttcctcatacaaatcttgagcaagacaaactttaacattcttactgtgatacaataaccagtaattaactctcacaatagaaagaggcttctttaaattctgcccatgatttttatccccaatctaaatttatacaaagcaaatcaatcatatcttgtaaaacattcttcactctctacttcaggaaaatatcaccctccaattcaacaaaacctaacagtgacatccttaaaacccctgaatgaaaaagctaattgctacaactctgcactcatttctattaacaaccatgccaaatagcaaaatccagaagccatccacaggagcactaagacttcaaagagagctcatttgtacctgctttgcctttcaggattttattctggtaatactgccactccagctgggggttagcgccaggacgtaaaggtgcccttcctgtgcctctgttacttgtaacagccactggttttcctgtgaggaaaatattaaattatttctgtatgtggtacaggaatgttaacaacatgtaagcaaaaatttttcaaaggattttaaaaacatgccttttttttctttagctttacttagacattaatccttaaagaagctaatactttaaagattatcaatcaccatgtaaatgtcatttaagtttcttagcacctccagaaaagccaattatttgtgaccattttgatacatttattcaacctgaaagcagcagtcaactcagccttccatggtttttgtttgatttcgtactgtaggaaagaggcaactcaagagtctagattcagacttaagtagtggggaaagaaaaactaaatttttttttgtatttctagagttaacatctatacttatctctcaattttacgcaacagaaactaaatacatatgcataggaatcacaatctgacctaccacattatcaaacatgagcatacagcccctcaatttttgctttagtataaacttactttcctgtatcatttccttttgtatgcatgttaagttacaagattactataaatttgtaaagcaatagcagggataaatatatatttacttaatgcattattctgaggaccaagaaataaaatcaacaatgcattaaaaagctactctatgaaaatcaattatttaacattctaaaaactcctttcagagctgaggaactactacccatgacaaaaataaagtcctggttttaacacagcagcttctgtgccatagtgattccttatttaagggaagaattgattctcagaagaaaacactaagttatctctttcagacagaggtaaacactgaaaaacccagaatgtatgctttttaaaatactgactagttcacaaatatctgcaatttcactaagacaaagactgtccagacgacttaacacattttagcaatattcaataatgcaaaactatcctacaatcaaaaagttgggatgttcatgggcatcaggacagttaatcaagttatttgctcaagagaaagcatagtgacccaagtctcaaagacaagagccaccataaaatttccattcattaacaaggaataaatacagataaaaatttagaaaatgcccaatacagatcctgcctacattagtcttcgatgacatatccttcagctgaagatgaatattcttccctgaagatccctatagggagaaagaaaaactctaatttccctataccttccctgataatcgaatatagaaaatttggaagaaccgattttcccaaggaaaatcataattttttaaaaaaagattttgtaatctctttgaatatatatttataacaatatatcagttttcttaaaacataagcaagaatacagacctttgagatctggtctatttcgtatacccactgatacaaagaagcaatccatatcaacatgcattatacagctctgatgtctgggagaattcaatactgacatatctcctagaaggaaaaagacagcattcaaaccccaagctaatttttactatttaaaacatcaggtctagttaattttagaaattatatttaaaacatgcttacacccagaatggagtctttttaaaaaaccagaattgagtacagattatttctatcacctcaagagaagccaaatttaattaagtctctaattagtcaaaaagtgcatcttaaaattatttcactgtgctgattattttataaaaatacaaaggtgttggcatacatttagttacatgaagctaagtaaaactttttttgatgatcactattccatgcaatctacaaacgcgcctggataaaataacaacaataaaagtgactactattatccagtgcttggtaggtgtcaggcactgctgttaagaggtttatgtgtatgtatttatttaaattctcacaactatgaggtaggtaatcgtatcatctccatcttgtagactaaaagtttaagtcacatagcctattattaaatggttgagctgtgattctgtctcaagcagtctgatttcagagcctttaaactaccatgttgctgttctaagtacttaaaaacagtctataaaatgtaaatctgtacatttttatccttatgccattaaatactattaaagatcagagctgaatgacatataccacatttaaggagataaaggtgagtgtcctcacctaaggacaaaagcttctaatcatcctgagctacaaagagattcatcagggtcattttaaccctaatccaggcacaagcagagctttcctctattatcagtctcatccttagcctgttcgtctggtcctctaagatacacaaatcctggaaaaagaaccctgggcttgtaaaaagttctgatctcataaaggagtttttctcaggcttaaaaatattagtactgagggtcagtctttataataggcttccaaaaacagatatcccctaacagttttggaccactccatttaccaaactgtgactgtgatagcatgtacctaattctcccccaactttttttttgttttttttttttttttgagatagggtctcactctgctgcccagtctggagtgcagtggtgcgatctgcaacctcaacccctagggctcaaacaatcctcccgcctcagcctcccaagtagctgagaccgcaggtgcgtgccaccacgcccagctaattttttttttctttttggtagagacacggtctcactgtgttgcccaggttggtcttgcactcctgggctcaagcaatcctcccgcctcggcctccgaaagtgtgcgaattacaggcatgagccactgtgcccagcctgctcatgtattcttaagctcacaaccccatgaggcaaacatcatggactatctatcacttctattcacaaagaaaactaagactcggagaggtgaactaacttgcccatagtcctgcagcctaagagtggcagagtaaggatttagattcatgctaaactatctaactccaaagccagatacttccttactaccctctatattatctcaagaaatgattcataaaataatcttaatcacaattctgctgtataaaagtatttttcaaaatatcatataaacataatgcaaacaactcaaaataacgcttttaaacattcaagtagtacagaatgcataagccagtatctaccaaatgctttcatacaataacaaaatttctcattttattcccattcacagaactaattaatcatagttcttagaagcattaagaattaaataaccttcaggtaacaaggccaagacatgatgtaaggataatctagtatctatattattctgaaatatttcataaataccaaaaagcattttttgactaaaagcacataggaatacatcaaactcagtaaaacataacagaaaacaccccacatagagtctctatcactttctaggacagaaccatgagcttctctctatacctcagtttccacagctataaattatagagtattaatctctgaggtctctccccataaaaaaatcctataatctgtaaaaggaactaaaatttcaaaccagatactaatttataatgactggcccagaaaaacagtatgctactgtgtgtgcatttgtttttgatgacaagaaaagtattaaaaaacaaaatacaatgaaccaatgtacttaagatgtgaaataatctcactgaaagtttaccactgttaattacaacagctctatgtcaaaattaaaaaatcattatgatgcaagcttctagaaattaacaattactcttatcaaaccaatttcattcttacaggagtttaagcactggatagatgttatattaacacagttcaaaacttcaccaactgataaggtctacgtgaggaatgaatgctcagaatcccaaccatcttactgtttaaattctctgaaaattttcagtcagccacaattatatctaattgttttaaaaatattttaataaattagctttctatgttatgcttactgtaacttacatgatttgacatacttagagacttttatgagaacttcatattgaccagaaataccaataatagcataagagcaaaatgatcaagcatgactgtttcttaagaagacaattttaataagtatctacctgtgtcagttacaacaagtgcagacctgcctgttttcattttttttaacttttcccttcctggaaagataccattactttgtctttgtagggtattgacaaactcagtcaattcacacttccacattgatatgtgatgcagtcttgaatgagaatagaagtttgaaataaaattgcagtctgaaggtttggatggcactgaaggtgctgccttgctaaacgtagatactgaagaagtgctttttgtgcttgaaggcccctgaacagtggagtggtgagcaccattgattttagtgttactgtgcaaaggtgataatgagaaagaattagttctgtgtggattccgcaaagcatctgtgtttctggtgctttgctgcaactgctgcagagtgcagtctctgaaatcagtgctgctcttctcagccttatcctcctcctgggaaaaggctggagaaagcctgctggcaacactgttgaccatgggcaccaagcaatcctgtgtctttaaggcaccattagagctaggagtgtgtccattaaaaatggcagtgctccctctgggatgcggaattccattctgtttccttcccggagaggtctgctccagatccacaaaactaaaatcattattttcatcttcttcattccaactgttcatgccattgactttgacttcattttccgtttcaatcttcttaacgatgtgatttctaaagcaggaaaaaatttttgagttaataatatctgacttttaggttaaaacaattttttcatttcatcattttcttagtggtacacagtttggtatttccccctttaaaaacagaaaattcttatattgaatattgacaatgaaaaaaaaaaaccctgaaacttaaaccacaaactttatattctgatttgacaaaagatcattctttgcaaaagtagcaagataactagaaaaattctagaatattaacagccctttaggtgttttttgtttgttttttattttcacttcagatagtcccaaagaagaaataaaatagaacatttctcatggctgaagaaaaacccaaaaaacttttcagttatttttcccataaaaaattaattggaatctataagctgtaaatacccagttctgaagcacagtgcttggcatttactacatggtcaataaatatctgctgaattaatatactacaaataactttcataaaaatggatttaaaaaccttacttgaattcttattcctagttttagtttttatgaaaggtactattcaacacattaaatctaatacgaaaccagatggtttcagtaggaaaaaaactgactatattgattaacctattaatgagctaactgttgcacaaatagacaaaaagtaaagccatgtcaatgtgtgggggtaattcagtaaaatttacacctagaaaaataaggacgcttgccttactgagaagggaaattgcacttcatttctaagaaatgcatatttagatgccagggtggtacaaggcaatctggaccaagtttcctgatgacagctttataaatgcagaacccatgacaaatgttatgctaaagtcacatcctggctcctctagacgtttgtttagaaatgcattcacgagaatcatctaagtaacaaaaacaaaaacctgaattacaaagcagtaattcattctacttaggaatgtccaaatgtccatagcattaattcaattacagcgcaggctccagatgaagggctgccctacagagtagtaagccacaggtgaaattaccacagtattatcaggttccacctaaagcccctcaccctaataccaacttggtttattagtaatgagagcctgactacacagaaaagtcccacaagctggatgatcacccatttctgggttagctcaggctctggctaaacatcatatggaatgtgacaggcaactgtgagtagatgccatgctcacagatgatcatgccagtgatggggaaaaagacaaagtagatatgattaaaagaagaaaaaaagaaaacctaatttgtcacatgcagagaaagttcagcctcttgagataaacagaatgcaagggagcaagaagtcacagatgagcatttcaaagaaatgtacaaaatgtactgaatataccccccaaaaaaaccccagaaaacaacaaaagtgatgtacgtcagaaagtcttacatctagttttgtgtcaaaaacattcagaccctttacatgcattatagcaacacatgcaacagaaagccatatattggcaggaaaatacattgttaacatacattcttgctgtactatagtttctcagcctagacaaatggacatttgcaaagtagctgtactggaaatatcacgggtagagatacattttttaggcaatggcataaatgtattaagaagtaaaatctaaaaggtaatttcttcctaaagtgtcacaaagaagattttgaaaaaacatatctattttctacttttattaatgtgggtaagaaaagaaagctaaagctacgtattctgtgaaaaggttttctggtattatttgctatataccttgatagcacattaaaaaaaattaaaagctacaggtaacatgaaaaatatttgaatatgcttgtgagtacaagttaaattaacaaatgacaacaaaaattacagaaggcagtgatactggatcctctcagattaattagactcctggtgttttcgaaaaaaaatatatccaactcccaaagcaagcaatttaataaataaagagaaggctaaccataatgaaccacctgatatacaaggtaaggcaacccaccaattaattgtgaaacaatttatccagggttgcaattaaaagcttaaattaaaaaaaaaaagcagccacatggaatagtctagattcactttcaattctataaccaagggtcaccaactaaacttccatttatatatttacatatttagaatgttatgaattttgaatttttcaaaaataacccagaaatattaacattttcattgtctttctatgcatggaacacaacaaaaatatagctggtgcagttagttccatttttgagaaagcaatacagcaaattacttgtgaggaaataattactttcataaaaatccatgaaaaaacttattaacaattaagatccactagtttaaggtgagaaaccagtatgactgtaaaaacttacttacatttatgaaattatcattataaaaataattcatttttagataagacactcatacacacatatttcaacatgtttattataagtgaatggccagggtttgtatctgcttctgtctgactgtaacagagcaggggccatgctcactgctaaaaaccagctttgtggccaggcgtggtggctcatgcctgtaaccccagcactttgggaggccaaggaaggtagatcacaaggccaggagttcgagaccagcctggccaagatggtgaaaccccgtctctactaaaaatacaaaaattagccaggcgtggtggcacacgcctgtaagcctagctactcgggaggctgaggcaggagaatcacttgaacctgggaggcagaggttgcaatgagccgagatcataccattgcactccagcctcggcaacaagagcaaaactccatctcaaaaaaaaaaaaaaaaaaaaaaaaccaaccagctttgcagtaatccccaactagacaaacttacaccctgttgttgagctgtttggctatattgcttggacctggcagaggatcctcaggtctgcatacaggattaaagctgagacctttctgcacactggactgcttggtgtacagctgatatggaatgtaggagaggagtcgtccagctttgatgctgaaacaaaaagcaacaccaatttagagttccatacttggtgacaatgagcttcatgaaaaatattcaatgtccttaaagatacagtatttcaccaacaacaggtcatctgttttcctagtttattccttcttgctcggttttagtggtcctaatacaatatgatcttagagtggggaaaaactgcaagcacagagctgaactagtcaatattttaaacctcatgactttagtatttaccaccctgtcaacagttaacagagaatcatcaagacttcatcaaaatctcatctattaaggttttccaagataaataaactgaataaggatgctcaatttccaaattcatgtcagaaactgtaaaataaaaatataggacaaaataaagaatctcaacttcaagagtaataatttatactatttttatgtatacaagaatggttaagagccaaggccatttgaagatatgaactctacaagggccaaaactaccatgtacatcctcacagcatatcacacaacaccactcaaatccaggggaacaccagtgttctaacgctaggtggtactagcactgtaactgaagttcccaaatgtctgcttccttttgtacttcagaactaaaactaatttgattgcagtatctaaaactgacattttcttgctaataaactgagttatatatggctactctacctttaaaattatcatttcacttcaaatttaaaaataaccaatcaatatacttatgctatcatccaaatttcaaaacaagctactttaatattagaaaatatttcaaaacaacctctggattttaaacctaaaatatataccaaggaatcatccctcagttatttagaaaaagactgataaataacatgataaaaatatgtttcttattgtctcataaatccaagacttgacattttcattttcttaaatggtgtcacacaaaactttttaaaaaataatcatttaagaaatgactgaattggcttacagaatactaattaaaaataactgagtcaacaacttggaatacaggaaaacatactaacagattctaaaaacggaactatatatgatacagagtatgtcctttatataattatgtcaatatatatttaacaattctacctaaagtaccttaacctatatcaaatgctataactattaaattatgatggtaaagaacatactatactagtcgcaagacatgtaaccaaatggatttatgaccaggctaaatgttttaccaaaattcaggttacattcaaaatacattcaaaatttcaggttacattcaaatattagaatcgaaaccctaaaattcgactattttttactttattcttcctcaaaccaacttttcttccttttttttttttgagacggagtctcgctctgtcgcccaggctggagtgcagtggcgcgatctcggcttcacgccattctcctgcctcagcttcccgagtagctgggactacaggcgcctgccaccacgcccggctaattttttgtatttttttagtagagacggggtttcaccgtgttagccaggatggtctcgatctcctgacctcgtgatccacccgcctctgcctcccaaagtgctgggattacaggtgtgagccaccgcgcccagcccttttcttcctttaatagttggtctcaattgcctaactataaatctttgttctgtggtattatgtatatcaaactcacttgcttcccccaccaaaagaagtacagctacttaatacctgaaataaaatcctaaccttagctttccatcctttatcatagatagctataactaagagacaagtagagagtgaaactacacccactgtgccagctgcacatctcaggtaaaaccaaaagtgcaaggaacaaaacgccctatgatcattctcgcttttcctgccctactgacagcatgctggagtgatgcagactctacaggtactctctatggtcagcactgatcatatacaagggtgtcaggccttatccagctcctaacaagagccatgtggccacccacagaattcttaggcttacataagtcagtccatggagactgctacaaaattagacagccaatttaaatactgcaagtctcaaatcagatatcctcagagatactcaataaaaagaattaaagcccaatgcactacagtaatgttagtgaagtaatgtcagttataatttgaagcctaaaccactatctatcagttgtatactcctaactacccctgcttgcccatttatctatctatagatatatagacagaaacattatctgaaagcatatttgtataagacctttttaaaaatctctctgggattaatttctcacatttactatttcccctcttgttctaagcgcaaaggaactgtactgacattttctactattctttcaaaaccaaaaggagaggataataaaaaaatccatctttatccaaaagataatactacacggtttccttatacactgagttttttcatgtacattgaaactatattctgatatatacatgaaagagtttacattctatacaacgaatcaaaacatagtcatagcaagtgaaatattcatctattttgggaagtcttactcttgctttgtcctacagcctctgcgtttaggaacaaaaaaaaaaaacacaaggaatggcaaaaaaaactcatgagagataaaattgcaatcaacttttatttaaatgagttgcataagcactctaatatttaaacactgaatgtaattagaaaccaaagttttgactcatatgtaagcacatgacaaacgtatatggtttgggagtttagaaagaaaagataaactgaaagtcctactagtagatcccattgagctggcatgaaccagaacaataaattatcattctgtctcaactcccaacagatctatgtgaccatctaatcacgggatatacaaatataaaaaacccacgctacaaggttctcaatctacaaggatcaacacaaaatcaagaacaacaaaaacaagaacaatctgtagcaacttaggacaatatttttaaattatgctccatgacactcctcaggtttggtgggccagtggggtacgtcatagcagcttctcatctattccacatttcaaatttcaaggtaaaattgtctcaagacaaagactgtgacaaaaattttttaaaccattacttttaatacactatgtacaagtgtgagatttacaaaacaaaggttttagtaaaataatttcacactttaatgtacacaggctcctcatgaaaggattcccttgcctcttcaaagtcagggccctataaccatgcctacattaactcagatctactgacatacagacatcagggaactgaaattaaagcaacaccccacatacttacaagtggcagttccttttcaaactgctcgaataaaaacaaaaactaattattcagaagagtatgtaacgtttattaaatagctaatacatgttaaaatttttaagtataataaaatctcattaaaacacagctaagaagagatcaaccagggattagagtgtgaataaaaacagtgccatgatttaaccaaaaggattccctgttacaatgacataatggactcctggcatttaagatatatgccaacactgatccatttccacatgggccatctataacaagcttaattaaatggtaaaaagaggacacaaacaggattcagaacacctggactctaaaacctactctgttcttgggcaagtcagtgagccccactggccctgtctcctcaaatacaaaatgaggcccataggatatataatcatgctgtccaaaatcactcttaattatttaaagacaaatgattaaacctcagtccagactaagataaaatccattaaagtgaattttaactatctaagttgctttttctatcttatgatctccctaggcgcatctggcaaaaagaacacgtgcaaaacaagcaactgtaatggaaaatagcattttcttttctttttcttttttttgagacagtctcgctctaccacccaggctggagtgtactggcgtgatctcggctcactgcaacctccacctcccaggttcaagcaattctcctgcctcagcctcctgagtagctgggattacaggcacccaacaccatgcctggctaatttttgtatttttagtagagacaggctttcaccatattggccaggctggtcttgaactcctgacctcgtgatccacccaccttggcctcccaaagtggggggattacatgcatgagctatcgcacccggccggaaaacaccatttttctaagtaaatcaattccccccagcaagatcgctttcccctcaactctcctcctgtccacagaaattccccattccctccaaagcctaactattgcccccagataaaaactctagctctagtgacaacacagctcaactctgagtgatccaacttcatatactaagaccaagtcctttgaagagacacatacctaaaagccattttaatcaatactatatcattgatagacagtggttaggtcatgagaccacagtgcaaaggaaggaatcagtgggatgttatagggacgagcctttgactttatccctccaggtttaaaaaatccttaatatgtaaaatgttatttatttgacttttttttttttttagacagagtctcactttgtcgccaggctggagtgcagtggcgtgatctcagctcattgtaacctttgtctactgcaacctctgcctcccaggttcaagcgattctcctgcctcagcctcccgggtagctgggactacaggcgcgcgccaccacgcccagctaattttgtatttttagcagagacagggtttcaccaagttggccaggatgttctcgatctcttgacctcgtgatctgcctgccttggcctcccaaagtgctgggattacaggcgtgagccaccgcgcccagccaatatatttgactttctagagatagtaatgtacttttgaatttttggaattttctaataattgctaatgttacagaataaaaataaaatagtaacagtagcttcttatatattacacctctacaacatgctaggcactgcaccaggttgtatggacaaatgatttttatttctcacataaccacagcaggcagatattagccttctttcacaaatgaggaaacaaggtcctgagtgactgcataaagttttttttttttttctttttcctgagacggagtctttctctgttgcccaggctggtgcagtggcgccatctcagctcactggagcctcccatctcctgggttcacgcgattctcctgcctcagcctcccaagtaaccgggattacaggcacaagccaccactcccagctaattgtatttttagtacagacagggtttcaccatgttggccaagctggtctctgcccacctcggcctcccaaagtgctgggattacaggcatgagccaccatgcccggccaagcataaagtttctaaaattataccaggttatatggatactgaactgccgagtttggaagttctgaagccaagtatgtctccagagcccaggcccagccttttccaccacgctgcttctccgtgaatttatgcggctaaatacactatacaaaggaactgagttaatacttaatttgtggaacagttaatggagggtgttataattagtaaaagcaagaactagaaaaaaaattcagcaactgacttaaaaagataagcaatctctcatacactgattataatctatccatacataaaattactactttaatattttacttcttttataaatcagtaattgctcatatgtattacatacctcatgtcatttaaaaatataaaccacttaagttttagctcatctccaaggtttcagatgacatatttaaacttaggaagtcaatatgaatgtcaccactgatttacaacttatcatttccaaaccaacagcagagaaaccacaatataatcattaaaaaacagtaaataatactgcgactgtactccctcctttccccctactcctagcattctaggtccacattatcttgatgtattaccatgctaaaaacctatgtgatagacaacatggtataatgtactcatacattactcattctttctctcccaacagaatataaactccatgaggtagtgaagggatctttgctttgttcattgttatttcccaagaacacagaacactgcctagtctttaagaggtgcacacatatttgttgaataacacgcttgctccaccttctcccataactgcttcctgacactttcctgagtcatcacccctaattcctggcaaacacattaacatgctacttttattaggatgccaaatcctaggctatagtattatcaacatgagcttaaacggtagtgttgtttaagacattatttttcaccctgtcaatcaggaggcaatatattagttacaattttataaaagaaatagaaaggccatgcgcagtggttgtagtcccagcactttgggaggccaaggctggaggactgtttgagtttgagaccagtctcggcaacatggtgaaacccatctctacaaaaaatcagccaggtgtggtggcgcctgcctgtagtcccagctactctggaagctgagatgggagggctgcttgagcctgggaggttgaggctgcagtgagccatgatcatgccactgcactctagcctgggcgacaaagcgagaccctatctcaaaaaaataaataaataaaaagtattctaactttaaaaatttattaattaaatttaataaattaaacttacctttccacaatccattctggtcgaattactttttccccctttaattctttaattttggcattgggaagatttgtggcaataatatgtgttgttttagatctggaataatatacatggtattgacctccatgcaacatcattagttttctcaattcctcagcggaaggatctgcaaaatttatattaaaatatattaagagtcttatgtgtaagaagtagaaccctaatgaataactccttaaataggtcaactttaagaatgtcattggttcaccttctccttggctgtgttgccagtaaacaaagctgggaggtaaatcacaaagtgagaaagctatgttgcttttagtacatcccccttccctggctgccagacaaccaactaacacaaaaacatctaagaagtgcctagcagagcaaatagggacctcaagtaatgaatcaaatactaataacagtacaaatatttttacattttttactatacttagcatatgaccttgatattgtgtttttaaaaattaacaactataaacccatttatgaatcattttacaaagactaatccttccactcctccagagtatacaagaggagtcagataaataatagttactcatatttactaaaaaggagacttactgtagggcttattagtagattttacttctagaaagctttataatttttatttttatttaagaaaatatcttaaaacttaatcaaatagtaaatattatccagttccctaatatgaaatttcattaaggccaaaaaataaagtccagcaaaacaaaaaagactgcaaaccaagaaacaccaatttttttcaattttgtttcaaatgatttattcttaataaaactacagaaaatatcttatatgtcttaaatattggaaatattttaagaaaatatcttaaagacacaatgtgacttatgcttccccctaagaagaaatgtctgattcactaaagtcatattatggcctgcattactagcatcacattaatcatcactgttctctttctttcacctatcatcctaatgaatgctctaactcacacctcccctaacaacagctgtacccagggggagtttccacatgtggcttatcgcaagcttaatcccaagcaatataggtccaagtatttaaataaacattttcattatgacaataattaggtgagctttagtttctagaagataaaaaactaacagcacatacagacataccaggtttgtctaaattttacagcacaaaatttgacattactgattacaaatattagcactattcagtagaaaatattatgcaagccacataaataaaaattttctagtaaccttattaaaaacagtaaaaaggtgaaattaattttatttaacccaatatatccaaaatattatttcaacatgtaatcaacagaaaaaatctgagatatttactttcttttttcttcttaaatctctggaatccagtgggtattttacatttacaacgcatctcaatttagaatagccatatttcaagtgcttaacacatgttactagcagctaccaaactgggcagtgtcatacaaagagatttaaaagcatccttttaaacaaaatgaattcaaaattaataatggaagttttcagggttaaggttaagttaaaaactgaactacagcatcagagtgatttaatgtgaaacagtagaaattaaacagctagccagtcaggaatctacagttcagtttctttctctaacactaaagaacctggctgatcttatagaataacagtgagaagtatcaaattaaaggctacattacaatgcattaatatgggcaccaaatccaatgaaatcacagaaatctaaaaaattaatttgcaagttaatctgtaactttcctaaactaattctatttaatgacttaaatagaaaacggctgtcctttaccgaataaaaagacacgtcaagaacacattaactttccatatacatactcataaagtactcacccgtctactagctgctctttgaaaactaattactccagaaatttggaactggaaaatacattgcccttctactggatgaagttaagagggctctttgaagttcacttctgaaagctcttacatattcttcagtgtgaagtgaagcatgaaaaccaatctagttaaaaggcaagatcacataaactatggaataagaccgatctgagtttaatcttagctttcacactcctgagttgtgtgactttggagaagttgtttaacttctttaggctttctcctctttctccataaacaaagctgttacaatgaaattagtctggcatgtagaggtcactcaatatgaaaactgctattattataaactatgatcacactagaactcctttcgagtaatgtatatgacctcaggatcctgccctagactctacgaaaaaaaaaatgacagaagacaatatacataggctgacacatggtgacccaaagtttcaacaaaaacagacctgccaatagtgcactatggacagcagccagggaccactttgtcaggtccaacaggctggcatgctaactgttggcatgcatggtcgctggaagctaccctattttgaattttttttttttaatttttacagcagtattcctctctggttctatttcttcaatactagaacatactcccttattacaagtccaaaagaacatacacgataactgcagatttgcataataaattcatttttgtatttaacactctcctttaattcagcagatgtggggttaattagaaaaaaaattgggagccaagcacagtggctcacacctgtaattccagcactttgggaagccaaggtgggcagattgcttgagctcaggaattcaagaccagcctggacaacaaagtgagaccctgtctctacaaaatatggaaaaaaattaaccaggtgtggtggtgtgtgcctgcagtcccagctactagggagtctgaagtggataccttgagccagagaggcagagtttgtagtaagctgaggttgcaccactgcactccagcctggttgacagagccagagcctgtctaaaaaaaaaaaaaaaggaaaagaaaaaaaaagggggagataatatccaacatcatgaaagctatatgacattaaacattgtgtgacacactgcctacagaacccatctctgcaatgtactgtaacagttaactttctccatagcactgataatctgaaattaccatgtctgtttgtttacttgtttactgtcagattcccccctggaacatatgctctttgaaggcaggaaccttgtctgtcaagcactttcatatccctgacataaagcaggtgctcagtgagtatttgctaaattcattaacatcctcaatgcatcccagactcctgcctagaatccaccctccagcaaaagtggagtacaagtggtataaatacttaaaatctcaaaacacttattcactcactcacaaattagagacgccatataatgtattaagaggacagactccaaagcaggaatgactaaggtcaaatcctggctccatcatttgctagttacttggatttcaggcaagttatttaacttctcagaacctcagtttcctcacatgtaaactggggataataatagtgtctcaaaggacttctgtgggaattaagagctaaaaattataaattactgagaaaagtaacttgcatatagtaaaaattatgtggccaggtgcagtggctcacacctgtaatcccagcactctgggaggccaagggggagggatcacgagatcaagagatcgagaccatcctggccaacatggtgaaaccccgtctctactaaaaatacaaaaattagctgggcatggtggcacgtgcctgtagtcccagctactcaggaggctgaggcagcagaatcgcttgaacccaggaggtagaggttgcaatgagctgagattgtgccactgcactccagcctggcaacagagcaagactgtctcaaaaaaaaaaaaaagaattatgtgtcagctcttaacaatattatcagtattatttttaccatttcttaccccaaaccgggaagcaagaaggagctctagagctaaagctgctctctattcacacaaaacattaaattttgcaattcataatccctcctacaaatccttctcttgttgcccacccttcagtatatactccttcaagaatgtccttgatgtactagcaaagaataaacagaaaataaaaaatcaaaacaggccaggtatggcggctcacacctataatcctaacactgtgggaggccaaggcaggcggatcacaaggtcaggagttcgagaccagcctggccaacatgatgaaaccccgtccctactaaaaatacaaaaatcagctgggcatggtaacacgcgcctgtagtcccagctactcaggaggctgaggcaggagaatcccttgaacctgggaggcggaggttacagtgagccaagatcacgccactgcactccagcctgggtgacagagtaaggctctgtctcaaaaaaaaaaaaaaaaaaaaaaaatcaaaataaaacaaaactagattcagggaaattctatcctccaaatttttacaatcaatgtcactgttttgaaatgtcagagtgagtgcttttctcctcattgttctttgcctttttattttttatttagagacagggtctggctctgtcacccaggctagactgcaatggctctatcatagctcactgtaacctcaacctcctggttcatgcttgtaatttgaaagatttgggaggctgaggcaggaggatcatttgaggccatgagtttgagaccaacctaggcaacacagcaagatccgtcttttaaaaaaaatccacaaaaaaacaaaaacaaaaacaaacagaaaaggctgggcacggtgggtcacacctgtaatcccagcactttggtaggccacagcgggtggatcctctgaggtcaggagttcaagaccaagtctgaccaacatggagaaaccccgtcactactaaaaatacaaaattatctggatgtggtggcatgcgcctgtaactccagctacttgggaggctgaggcaggagaaccactggaacccaggtggcagaggttgcagtgagccaagatcccgccattgcactccagcctgggcaacaagagtgaaactccagctcaaaaaaaaaaaaaaaaaaaaaaaaaaaaaaaaaaaaaaaaacccaaaaattacgtgtggtggcacacacctctagtcccagctactcaggaggctgaggcaggaagatccgttgagctcaggagtttggggctgcagtgagctatgatcagtctactgcactctagcctgggcaacagagcttatcttaaataaacaaataaataaaattccacaatactcctactattagttttattttgcagaacattctatatgcaactaaatttgaggtttaactaaaaccagacatagtgacagacaattgaaagcacagtaaaagtaaaagccatatacaaggaccacaatttagcccacgtttagacctaaagccctacaagtaaaatgtcacaagagcaaatgccaccatataacatcaaaacagccatatgaagaccactttcacgtctgtaggcccagcttatagaaagttttgctcatctggttaaaacaaattctataaacaaaatttttaaatcttgcacaaaagctttcctagctagatctctattgagaaaacatttactatatgcaccatttcctcctgcatatccaaagaacttaattaattgttgactgtgctatataaatcacagaaagaagtgaggtgaatggctgcttatacctcctttgctcctaccatggcaacatcttcattatttcatttgagtttcacaatcttatgaattagaaaagataacttattgatgaggcaacagagaaaacttactgtgcatacccttctgtctttggactcctgtccctcagtttctgcagcagcaatactactctcttgactcttctcacccctaactacctcagacttaccaacagagtcaccacaatcaactaaaagccacggatacactcaaccaaacaaaaactgaagaaaagtttcaaatgcttagggaacaaatttttgagtaccaactaggtgcaaatttcacatcaggtactagcaaaattacaggaggtggcataaattaatatggtaagtcttctatgtcagaggttcaattcctccatctcttatctacaagatgagagtctcacaggaaatggaaggagagatattatatatccatacaaaataatatctgggaggcatttatttccaaaaaattagacttgtcaacactaaagagaatcctctcctaaaacaccacatttgtatgtttagaaaacatcaatgtaagctgtcagctttcaaacaaatccttatttgaaatataagtctgttacacttgcatattcccccttgtttcattttgtgaattgtgctaaagtacttgtccgggcccccctccacctgctttttcacaaacttcagcagtgccaaaatcaaaagacctggtcttttacccatgtactaaaggaagtagaaaataacctgaacacctctttccatatgaactgtcccaatctcacaccactaaagtgcaaccactgtccactaagtctgaagcactcactccccctgggcagctttcacaaaaataaacatgcccagagcctacctcccagattacaatgcaggcctcaaatgtggcccattccttaagactgagttgatttagcatctgagtgaaaatattttaacattctgatgtacaaatacaaaacctgttatttatttattcattcaactaatacttattgagtatctacaatgtgccaggcaaggttctaggcactggagatatggcaatgaacaagactcaagtctgtgccccgtgatagcacttgtattccactgaggagacaaaaataagtcatgcaagtaataccattttaggtgcaaataaatgaagaggaaggtggataaggggttagagagcgactggagggcaaagtacacctgttttagataggtgaagtcagggaaggtctccgtaaaaaggtaacatttgagcagagatctgaatgatgaagacctgaggaagcagaaggaactgcaaatttaaggccctgaggtgttatctctaatccatgtttggcaagggattactatacataaaacaggcttcctaacgccaaagaacttaatatagaattaagacctaacaacacaagacaaaatccaggtgtcaaaataaatgtttctagcaataatgctatgaattatatatctctctatataaaatactactactatggactggcttagacagggaaggaggcaaaacctaactatatctggatcttaatgaatgaatatacttccagttcacagaagtgaggagggaaggagtttttcctcagaggcaaaagaacaaacagaaacacagaactgtaaaagtaaaaagacaaatctagaatatcagggtaatcttgttgagcaaaatttaagaacatgaggttgaaaatgtaggtcagaattaggactagaatgtctttctccattttcatttggaaaatgcctatttatctaagaccaagctaaacatttcgattcctttatgaagtattcactcccactcccaaaggcaattgtttcctcttctgtgttggcactcaccctcctctgttgatgtctaaggcttagagattactttttcatcacaaaatccacattctccatcaactgctatctcttttcaaacatagttcctaacccacaagcagcatccaaaatatatctgttcaatcaactaaagaaaaataaaatgggatataaggtctgtaaactagaaaactcaacatagtaaagatgtcaattctccccgaactgatctacaggtttaatgtaattcctatcaaaatcccagcaaggtattttgtggataaatgacttattttaacatttatataggtcaggtgcactggctcacacctgtaatcccagcactctgggaggccgaggcaggcaaatcacctgaggtcaggagttcgagaccagcctggccaacatggcgaaaccccatctctactaaaaacacacaaaaaatgagctgggcatcatggcatgtgcctgtaatcccagctactcgggtagctgaggtacaagaatcgcttgagccagggaggcagagggtgcggtaagctgagatcataccactgtactccagcctgggtgacaaagtgagaccctgtctcaagaaaaaaaaaaaaaagagagagagaggcgtaggtcctagaatagccagaattatcttgacaaagaagaaacaagtgaaagcaatcactctacctgatatcaaggcttaccacataggtacagtatttgatatagtgtggtactggtgaaggaacagacacaaacatcaatggaagagaacagagaacccagaaacagatccaccaaaatatgcctaactgactgtgttgcaacaactggaaatccacaaataaaaaaaaaaaattgtaaaacctcaaaatgaaacattaacttcaatgtaaaacataaaactataaaatctaaaaatatagaagaaaacatttgggatctagcaccaaagtgacaagttcttagacttgcaagcacaatccataaaaggaaagatcaacatatcagatctcatcaaaattaaaaacgttctgcaaaagaccatttcaagaggatgaaaaactacagactgggagaaaatacctgcaaaccacttttatgacaaagcagtagtctctagaatatataatgaaatatcaaaactaaacagtaaaaaatactaaatccaattagaaaatgaggaaaaaaatatgaacaaatgtttcaccaatgatgatgtaaagataagaaataaacacatgaaagaatgttcaacattattagccacgaggcaaatgcaaattaaaatcacaaagagatacaacaccatctattaaaatggataaaatgaaaaccactgaatgctggcaaggatgcaaagaaagttgatccctcatacaaggctagtgggagtataaaatactacaaccactttgggtaacagtttggcagtttcttacaaaaactaaagatgtaactattacgggaaccaacaactgtactcttcttatactcatacaaaaactcatacacaaatgttcatagcctaccaagaaataactgtgatgtccctaacagatgaaaggttaacaaactggtacatccacactatgaaatataactgaacaataaaaaggcaacaattttgatgacctgacagataatttatgctcagtgaaaaaagccagccccaaaaggttatatgctgtatgttttatttatataacattcttgaaatgacaaaattataaaaatggagaccagattagtggttgccaggagttaaggaaaggcggagaacagaagtgggtgtgactatgaaagagtaacatgaaagatctttgtagtgtggaggccgggcgcggtggctcacacctgtaatcccagcactttgggaggccaaggtgggcagatcacgaggtcaggagatcaagaccatactggctaacacggtgaaaccccgtctctactaaaaatacaaaaaattagccaggcgtggtggtggccacctgtagtcccagctactcgggaggctgaggcaggagaatggtgtgaacccgggaggcagagcttgcagtgagccgagatcgcgccactgcactccagcctgggtgacagagtgagactctgtctcaaaaaaaaaaaaagaaagatctttgtagtgtggaaatgttctgtatattaactgtatcagtatcaatttcccagttgtgacactgtttgcaagtttattacatattaccatttggggaaactgggtaaagggttcacagtatcactatgtgctatgtcttacaactgcatgtgaatctacaattatctaaaaaaaaattaatttaaaaaatggataggccagccatggtggcccatacatgtaatctccacactttgggaggctgaggcagaagaatcgcttgagcctaggagtttcagatcagcctgggaaacacagcaagaccttgtctctacaaaaaattaaaaaatcagctggacatggtggtacacacttgaggtcctagctacttgggagcctgaggagagaggatggcttgaacctgggatgttgaagctgcagtgagccgtgatagtgccactgcactacagcctgggtgacagagggagaccctatctcaaaacaaagaaacaaacaaaacaaacaaaaaggatagaaggcaaagaagtcaatcttaacaagcaaaaaacatttttggggccaggtgaagggaagaataggttgacaggtgaactattagagggtcttccctccaagttcaagttcaatgttaactgggttggaaggtatagggactacgaaatcatgagaggctcaaatggctgaactgggagctttaaaggaatcaagaacacttggattattacagtttgtggggagcatggttaagaatcaacaagaagggacaccacagcttcttttacagtgaaaactgcatctcccaggtttgcaaactgttcactggaatgaagtctctttcctccaaattccttttcagagaactttctattttctttttttcactctatcgccaggctggagtgcagtggcgcaatctcggctcacttcaacctccgcctcccgggttcaagtgattctcctgcctcagcctcccgagtagctgggactacaggcgcacgtcaccacgcccagctaatttttgtatttttagtagagacagggtttcaccatgttggccaggatggtctcgatctcttgaccttgtgatctgcccgcctcggcctcccaaagtgctgggattgcaggcgtgagccaccgtgcctggcctgaaaactttctttcacaatagcaatgagcaaaactgacaaagtctgcacctttggtgcttacatgctaatggagaagaaagatgataccaaaatatatatataggcattttacaaaatagctgaccagtactcctcaagactgtgaaataaagcttatttttttaaatcaaaaacaaaatagcacctcctacttgtcttattacatctaaagagttatttttacttgctaattgttaatgctgttttatctataaagtggtaaagtattcactaaaacttaatttttctaaaaataaagttattttacagcaccacagtttggatatctcggtgaaattcagcataatggaactttatttgtacagttataatgaaatcttaataacaagagcaaaaatattatcatctctatcctgcagaaaaggatagagataataacagatctaaacagaaaatgttttacagtcacacaaaaattagtgataaaagcagatttagaattccagattctcaatcaaaaagtgattactgcaatattcatttttcttccctcacacaaagaatctctttttcttcctcctatgtgaataagggtgctctcttgaactggagacttccatgactggctaatgtaagaagcaatgcctgttttcattaacgttttaatttttcatagagcatctcaggaagtccacagagcttgaatttgtcaggataccttcctacacagaaaagttacaagctttctgcatgtgaacttcccaatgctgcaccagcatttattttgagatgacattcttggactaaattcatcatcaatgatgcctaataaaacacttaattacaagcaacacactcttctcttactaaaccagataaatgtaccagttaattaatacttaactccaattcaacaaatatgtcctgaatgattgtgtccagtcactgtagaggcactaaggatatagtgatgaaaatgtagctccagctcttgtccagtaaacagacaactatggaaaggtctgaagaattctaagatgcagattcattcagggagccatagctccagaagagcacaagaagtcacctaaatcagtatgaagacagtcaaactatcaagggaaagcgaggcatggagacctgaaagatagcaggtatcagccagctgagaaggggacaggggaatatgtaacagactgacacaaatatttacagccattcacttcaaaaaatacaatgaaatgataagaagaagaatccccaagaaaatagagaaaaatttaggcagaaaacctggtaactaacaggcaagtgctaactgactttacagttcagcgaaagataaaactgaagctggccatatggaagcttggaaagaagctgcttgttaccagtaaaacaaagagaaagtcatgaaataaacacacaggcaccttcaaaagtggatgtgtggataaattcatccttgaaactgtgcaacaggcaaagaagcatttgcacatttctttcctttcaccaagaataaagactacactaccccttccagataccggactcaatgacaataggcacagctggtggggaggaggtaggaatgagaaaatgaatagagagactaagtgaaattttacttcctaaactgtgagaattcaggtcctttccttccctgcttggcgacccaaatgctggcagtttacactcttctacagacaagagagtaaaagattcttctctaggaaatctgacactgacacacacccacacaccaccccaccctaaaggacctatggacaatgacatctagagatttaccaatgaaatggacctacagtgaagctcacagtttacaagtcctactacccatgtgtggtaatttcccgtttttcattttaaacctcacgtgactttttgaaactatgtactttgataaaagttaaagacaatggcaggtaaaagcaacatggaaaggaaaaagaagtatctaagcagatgatttatttcttctcatcttacaatcatttgtctataataaatgagtaaaaatagaattttaaaacaaatcattctcaatcctaataaaaatacatgccaaaatagggttaagtaaaaagtactcaacctgtgtatccattaacatagatggcaactccactaaaaattgtagatgaagtcccatccttctgcatagcagcatctgatcgaaactgttcctccaatttctggaccttggcagccatatacccaccctagaattaaagaaaaggtaaaccaatcacaaaggttacattttctccccccttttttgaaaaaaaaaaattttaaaaactaaataaataaatggaccttattctgtgctagtgaccagaacataatgatgacctcataaacataaaccataaggcaaggcaataaataaaacaggaaagttgggccgggcgcagtggctcacacctgtaatcccagcactttgggaagctgaggcaggcggatcacctgagatcaggagtttgagaccagcttggccaacatggtgaaaccccgtctctactaaaaatacaaaaattagccgggtgcagtgccaagtgcctgtaatcccagctactcgggaggctgaggcaggagaattgcctgaacccaggaggtggaggttgcagtgaggtgagatggcgccactgcactccagcctgggtgacagagcaagactccatctcaaaaaaaaattataataaataaatataaatacataaaacacataggtcaaagaagaattttccctctatcaactcaagttttaattttattacattcttatgattataaaagttacttttaaaaaaagctaagtcaataataataatactggctgggcacagtggctcacacctgtgatcccagcattttgggaggctgaggtgggcagatcacctgaggtcaggagttcgagatcagcctgaccaacatggtgaaacctcgtctctactaaaaatacaaaatcagctgggtgtggtggtgcatgcctgtaatcccagttactcaggaggctgaggcaggagaatcgcttgaacccagaaggtggaggttgcaaacgagctgagatcgtgctattgcaccccagcctggacaacaagagcaaaactgcatatcaaaacatagtaataatatcacaaaatattgttcttatgtacacaattgagcaagctacaccaaagtttaaaccaattacaaatttgacaagtggtctcagagcatattttattttatttttttgacagggtcttgctgttgtcgcccaggctggagtgcagtggcacgatctcagctcactgcaaactccgcctcccaggttcaagcaattctcctgcctcagttcccaagtagctgggattataggtgctcaccactatgcccagctaatttttgtatttttaatagagacgggatttcaccatgttggccaggatggtttccaactcctgacctcaggtgatccacctgcctgagcctcccaaagtgctgggattacaggtgtgagccaccacgcccaacctcagagcatattttagactggcttccactatctcccacatacagagggcttaaaatgaattatttcaggtaaaaatgaggcaactggataaaccagtgtagtcctccctacacatgggaaagaatacaatgaatgctccagtggctaaattctggatctaatcaatctatttgatagtaatattaactttcattagataacattcacctcacaataaatattaaaaaataattttttttgctaaacatcttgacagatctagggattcaactatacttttcctgaactttgatataattaagcttgatttcaattattaggtctttaaattaaaggtgtaggtggctagaagtacatgatgtttttttcccaaaatggaaatgactgcattatttttgctgattattaaaatattatatgctcactatgaagtttcttttcagaaaatacaggaaatatggggaagaaaattaaaactggtataatcctattcattaaaactttggggtgttgttttcaaagcttatttccataactcagagcacagaggttttacaaacatataatcatacaaaatatttctttgtaacacattgttttagtcaaggttatccttccaggttgagatatataaagctgaataatgactgtacagtgctccactatacacagataacttatttgaccaatcccttattattggatatttatgtgttttcctgtttttctgtattattagcaatgctgcaataaaatcatcatatagtaaattattgtgcactaggcatatttatttcctcagggtaaaattcctgagagtaaagtttaggggataaagtttataaacatcataaggctttcaatacactgtgaaaactcaaagatgtggtgtctaaagtaatttacaatttagaaaacaacttaaaccacattataacagaagaatgaaaaataactagacagttcgatataattatttttactcttttaaaacacacccatgtttcccagccatcattttcagctcgcttcctccatccacctcgcctcatggtggagcttctgtattggggaggaaaaaaaaaatgtcaattttataacataatgtatttctaaatgatattttatttcaatatcaagaaaatgagaaattaaattcaaatgtccaactgatgaaagtatacaatattaagtaaactttttctgaagttctccattctccagctttacaagtgaaatttgtctataaaacaccctcctacacatgtttaaattgtaactcttatatttaaaattcaatagaaaaatatctttatgcattcctgagcaccaatcctaacattcacttacataaaacaccaaatccaactaacatggccatgcttactttacttgttaccattatataagacaatctaacaaaacatttcccttcatgagttgtcctatagtgtggcttttaaactctgtctttgctattacatactggacacttaagagttcagtcatagcctgattcacatattctgccaaagccctagaagaagtcaattaaaaatgatgcagaaaagattatcattgataataaactataatagtaaatctgtcattctccttaaggcaacacttacttaactaactatactataaaaccaccaggatgaccaaatgatggctcacattaagtggcagctggctcagtggctagcaaaatatataattcataaaaagaggctaaatgaaaccccttgtaaagtcaaagccttttaacacaaacagctacattttgggctatgactacatttattcttaacaaaattaatatgacttctattaagataattttcttctagtaactatatacatgtgtatcaaatggttaccatatgaagccttatatattatccacgtcaaatcagctctgatatgatctatgagaattttttacttaacaacaccttaaaccatgacactttaccccacacacattagcagataatttctttctttctttttatttatttattattttttttgagacggagtctcgctctgttgcccaggctggagtgcagtggcgcaatctcggctcactgcaagctccgcctcccgggttcacaccattctcctgcctcagactcccgagtagctgggactacaggtgcccgccaccacgcccgattattatttttcttttttttgtatttttagtagagacggcgtttcaccatgtgagccaggatggtctccatctcctgacctcgtgatccgccggcctctgcctcccaaagtgctgggattacaggcgtaagccaccgtgcccggcctcttttttttgagacaaagtcttgctctgtcacccaggctgaagtgcagtggcacgatctcggctcacaaccacctccgcctcccgggttcaagtgattctcctgcctcagcctcctgagtagctgggattacaggcacctgccaccatgcctggctatttttgtatttttagtagagatggggtttcaccatgttggccaggctggtcttgaacctctgacctcaggtgatctgcccgcctatgcctcccaaagtgctaggattacaggcatgagccaccatgcctggccagcagatattttcttatgaatatttttattcttagtatactgcaggatttggtttttgtttgttgacatttataacaatttgaatttttactgtcacccttaaaagatgcctaaaagacatgcagaagtgttgtcaaaaggttaagtcccaacagagagacaagataatacaaacgttttaggggcatgtgcaaggtgctccgagaaaaggtggtaaactgattaaccctgaggagagatttcttttttaagtctgatgaaggcaggaggagcatgaatacccaatgtgctcattatcaagtcccagaagtaccacatgctctgttaaatatttctcctgttttcaagaggctcattttgtccagtcccaacagacttcagcccttaaaggaaatctgggagatacattaacacacagcactggactacatgtaaactgaatccatacacctgctggaacaagtaaagagtttgggagttctggccattatacactaaaaacacataccccgataattaaaggcagctattaaactgttaaataaaggtaaataaaggagtaaagtgtattttaatacatttggtggcccaatcatttaagagatccagttgtgtaacgtctgttgtatacctactgcacaaggccaataagaaaattccttaatgatggtttaatgaggctagaagcatgaaacacagttataatacaaaaacaaaaattaaaaaaaaaaacagctattaagggttctttcccccaactccaaagtaacaaaactattccagacaaatgtttaaaactttaaaaggaaaaggaaagaatgaaggactgaaaattttagcttcgtcatttccaataacttgactcatgaacaacaaactcctattgatccagaaatcaaacaatcaaaaattactagccaacattccaaagaggacaaaaatcttcagagatctgccaccccacctctcttccccaaaccagattatttttccctctgagaacatttggcaatcctagaagagtggctgggagactgggcaaagtttctgacaaacagtgctaggagagaaaaagtagagtccaagggtcttccaaggataaagattgccgcaattgctatcagaaccctatgagtaacaagaaattggaagtagacagaccaaactttgcagaaactgtattcattatttcaatctctgaaaacagattaaggtgatcgtgggccaggcgtggtggctcacccctgtaatcccagcactttgggaggccgaggtgggtggatcacctgaagtcaggagttggagaccagtctggccaacatggtgaaatcccatgtctattaaaaatacaaaagattgctgggcacgatggctcacgcctataatcccagcactttgggaggccgaggtggacagatcacgtgaggcggggagtttgagaccagcctgaccaacatggagaaaccctgtctctactaaaaataaaaaattagccgggcatggtggcgcatgcctgtaatcccagctactcggaaggctgaggcaggagaatcgcttgaacccgggaggcggaggttgcggtgagccgagattgcaccattggactccagcctgggcaacaagagcgaaactccatctcaaaaaaaaaaaaaagaaagaaagaaaaattagccaggcatgggggctgtttctgctaatcagcagggatcttcgaaaaagagactccgccaatgcctctgtaataacatccagggaaaagttctccacactaagatgactgatttgcttctttaaataggactttccctagaacggaggagggcatttaatcaggataccactacttgacagaaatatccttcagaaataacacactccctctgtttttatcctgttccaagcaacctcctgaattacaatgtgtcctcttgactaaacctactcactaagaagtgactgccctgtattgacaaaccatccaattatcaagctagacttgtaaacaaaaattgccttctagttttcagaggaactcttgcagaccaggctcccaatttaattccacataacttgatgaccttgaggaatgtgataacagtttctgaaactgtgattcacaacctaaaataacctgccaatctctccttatccagtaactttaacagggcagccaattactgtgtttcaaaaaattagtttaaaaaacggatgaagagtgaatacatgaatgcaaaagtacccttacccttaacatttagggtacaccttcaataaacattaactactgttatagtaatctactctgccagtctacagagtgaaaatcgagtgagactacacacgtggaaaccctttgaaaactataacacagagaacatcattattttaagtcagttatccatggtctacaacataatgataacagtagactagatacggactcaaatcccaattctacgactgcctaacaatgtgattcagagtgagtctaacagcactgagcctaacatttcttcatctataaaacaaagttcgactgcagaatctttgtggggccatgactggatgaagggtggatatggtggggagaagaaaaaagttgggggtaaaaacagcaagcaagcaaggttccagtctctaagcccaccttcaattttagcagccatgctttttttcccccgtaagttttaggtttagggtctgaacaagattgttcttgaagaaaaagcacgacaacttgaaaaagactgataactaagagtaatgaactaaaaactaagtacaaaatttcttggttcttttctgtttccatgtgactctgtaagacagtcacatgtggaaatctcccaaccctcgaaaggttcacaagctaaaactcacctaccagctaaaactcaagtaatcaaattataaagaccaactgaattacaggctgtcaatacagccatgtccagtccccagtgctaacatgcagtaacaactagccaggtgaggtaaggttaaggcaaatgggagagcagctctgtctatgaggagcccagggatcctgaatgcctacacaagacttcctctttccattctctcaatagggatgttcaaaactctatcaagagtctcatcaaggacatgcttatttaaaaatataacaagactacttatgcatgcatttttcctaatgttttatcttttgctggaacacactactatcagttcattctaaactttattctgctttctttttactatagttattggtagattttactatctaccccgagaattatgtttatcaccaggaacattcattttcatgtaaaaatgatatttcctagcactctggggggccgaggcgggcagatcacgaggtcaggagatcgagaccatactggctaaaacggtgaaaccccgtctctactaaaaatacaaaaaattagccgggcatggtggcggtcacctgtagtcccagctacgtgggaggctgaggcaggagaatggcgtgaacccgggaggtggagcttgcagtgagccgagattgcaccactgcactccagcctgggcaacagagcaagactccatctcaaaaaaaaaaaaaagatatttcatctatttacaaaataattactagcattacaaggttctaaacagttcatcacacactagaaaaacttccactacatatccacaaaatgttcaaatgttcagtgttaatctgatggttacatatctgtaactctaaagtctgttgattaactaatgaaattcattttgagtggcttttaatcagtctttattaatacagtcatatataaatgtatacatttgtaaaaagcaaagtagaggttcctcttcagactctcctccccgtgtaattaggaataaatagtaacttctcttagaagcaaaatttattcaaagacctgtgctaacattcttaaacatctgctagccgtaataaagaaatcaatgtactttatgttcttagctcccacaatttagcctaaatatttgccccggcaagcttatactggtccaagcaagcgttaggtcatagcctgttcctcttccttatttgaaggtgtttttacctttctctacattccacaagttacttcctccttcctttgttctcctctgcctttgcctcttttaaaacaagattggctaagttgctagccaatcagaacaaatacagaatgtgaggtcctgttccagccaatggaaaccgggcatagcagcagggtggacgcatcaggttataaatgacccggtctcctttgttcggtgtactctcatggcaaaactgctggcgagtgtaccctttctgcagaaagtataaaaatggccttgctgaggaaattaaatttatgttcaagtgctacttctttacagcaccagggaacaagcattccaaagaggtttatcctatctttatgtaatagttatctaagaaatatttactgaatgtagttacaaattgacatgcaaagaatatgcaatgaatgaatgtgcacattatagtagcataacataattcatgaatatgacacaaatgcaaagaaagcagcctgtggccaccccttatctaggcaaggttgaaacacaatttgcctttggtgccctgccatatctctactcaacacctctctgttttcagtgcctctttatcttacttagctgtcaattctctgctaaggcatttattgacaactaaggaactggttaataaagggcttaaggtatgatccaacccagggtcatctgtgtttaaaagaacctcttcatgaccattcaatgaggaaaggacaatcttttcaacaaatggtgataggaaaactggatatcacatgcaaaagaagttggacctttacaccatgttaaaaaaaaacttaaagtgtacaaaagacataaatataagagctaaaactatcaaactcttgggagaaaacataaaagcttcatgacactggattttgcaatgactttttggggaaaatgtaacagaaaaaaacagataaactggactacataaaaatttaaaacttctgtgaatcacagggcaaaaaagggttaaaaggcaatccacagaatgggagaaaatatctgcaaatcatatctgataaggggttcatacacttaccaatataaagaactcctaccataaactgtaataataaacacacaacgccactaagaaataaaaaaaggatctgaacagacacttctctaaagaagatagacaaatggccaataagcacacaaaaaaacgttcagtgtcattaatcactatggaaatgcaaatagaaaccacaatgagataccacctcacacccagcaggatagctactattaaaaaaaaaaaaaaaaaaaaaacaagtgttgataaggataggaagaaattgggcccccgagccctgttggtgggaatataaaatggtgcagctgatatgagaaacagtatggcagttactcaaaaaatctgaaatagaattatcatgtaattccacttgtgagtatatatccaaaggcactgaaacctgagacacaaagaggtatttatttgtacattcatattaataagcattattcacaatagccaaaaggtggaagcaacccaagtgtccatccacagatgaatgggtaaacaaaatgtggtatatacatacaacgaaatactattcagccttaaaaggaaggaaattccaaagcgtgctacaacttgcatgaaccttgaaggcattatggtaagtgaaataaaccattcacaaaaagacaaatactgtatgattctacctatatgaagtatttaaagtagttaaattcagagacagaaagcagaatggtggttgcgggtggagttactgtttaacaggtagagtctcaggcaaggtgaagagttctggagatggatagtggtgatggttgcacaacaatgtgaatgtacttaatgtgactgaacagttaaaatggtaaacttttatatgtatcgtaccacaattaagaagaaaagagttttttaaaaaagtagttctgaagctggaaacactgtataggcacctgcaagctgcagtggacaggatcttcaggtggggtgcaaagctgggaaaaaggctacttcaagaaatctgtacagcagtacctgggtgttttgtttgttttttactttgaattggcagtagtgggaggccatttgtagaatttacaagaaccaggtattgcctttatgagtgactaagtacataaagtgctagcacgcatgccctaaaaaaagtttggtaacagtctgctccaatgtgctcttattctgtcctttaatggtaaaagttttaacagcacaaacagctttttatgtaacatttagatataaaaatacagctgtttgtgggttttgttttgattcaaccttacagaccatcattgtctacggctacagttttcaaacaattgctgaagttgtacgggcactacagacatgcacatcccacaaactagtcaggttttgatcttgaagggactctcaccaaggtatataaaacaaaacaaaaggccgggcctggtggctcatgcctgtaatcccagtactttgggaggctgaggtgggcagatcatttgaggtcaggagtttgagaccagcttgaccaatgtgatgaaaccctgtctccaaaaatccaaaaaaaatattagctgggagtggtggcgcatgcctgtagtcccagctactcaggaggctgaggcaggagagtcacttgaacccaggaggcagaggttgcagtgagccaagatcgtgccactgcactccagcctgggcgacagagcgagactgtctcaaaaaaaaaaaaaagaaaagaaaagaaaagaaaaaagaaaaaaattcagacacctaggtgaagggcacaatttcccagaagtacaagtactggctctggaaacctctacttgcttttagcgactgattctaaaccaagccaacagttcacattctaagcatagtgctgcgtgtctttcatgtatttaagatatcttttaaaaatatacaagtctaagatatttagatcaggctttattcctaacctaataaaacccatttttgccactttatgtgttttttttacaccttcagcatactgaaacattttcctgttgctaattttttctgctgcaataaaacaatttctgtaccagatgagatactatcttgataaacacagaattcaaagaacttcaatctatcaaagtggcacacagcactctccacagaaaaaattacaggttttggtacataagccttttcttgaagtaagtatgatctttccatcttttcttgggacattctctattattccttcatcactgacttgtgtttatacactgctttgtaatgctaagtacagtatgcaatcctgctaggtgttccttttcaaaaatagtttttcttgctctatttataaaagcaattcgtgtttattgcagaaaattggaaaatacagaaaacagaaaaggaaagaattacccaaattcctaccacctaaaaaaattcacctattaactgacactttatatttccttccttttagtgttcctttaatttttaacattcaaatttaatttatttacatttcacattactagtaatacctttcacttctgaagtatccttagttttccaagacccctttacatctaccatttatctttacaactcatccatagagtgagtcagccaagtcctatttattttgcacacaatagttgacttctagggtagagaagctaaaaagttctgtaaggctgcactgctggcttgtggtacaaaatcatactcatcttctacaaaattatgttcccaaatcttcaatggaaaaaataataatggtatcaatatgaactgctaaaaagttaagaatactcctattgatctgaagtaacctaacacaattcaacaaaacagatgcttcttcaccaggtaatctagcaacagtctggatcataatagagccatatatgtaacaaaactaaggaagaaaacaggtcctacaattaagctccatctagaccccaactagtccatattgataagcagaagtcgggagcgatggctcacgcctgtaattccagcactttgggaggctgaggcaggcgaatcacatgagatcagaagtttgagaccagcctgaccaacatggtgaaaccctgtctctattaaaaagaaaaaaatcagccgagcatggtagcaggaacctgtaatcccagctacttgggggactgaggcacgacaatcacttgaacgcggtaggcagaggttgcaatgagccgagattgtgccactacactccagcctgggcaacagagtgagactccgtttcaaaaaagaaaaaaaaaaaagaagtagagattcaaagacagcatcaactttgttgctaaccggttctctgaacttaagcaagtcataatcagtcatattttagttcctccgtatgtggaaagagttggacctgtttgaaatgcttgttccccggtgccataaagaaacagcacttgaacataaatttaatttatttagtaaggccatttttatttcctgcagaaaaggtacactcgccagcagttttgccatgagagtacaaggaacaaaggagacagggtcatttataacctgatgcgtccatcatactgctgtgtctggtttccattggctggaacgggacctcacattctgtatttgttccgattggctagcaacttagaactttttaaaagaggcaaaggtggaggagaacaaaggaaggaggaagtaacttgtggaatgctgagaaggataaaaacacttttaaataaggaagagaacaggatatgacctaatgcttgcttggaccagtataagcatgccagggcaaatatttaggagcacaggtctttgaataaattttgcttctaagagaagttactatttatttctaatcagatggggaggaaagtctttgaagaggtacatctacttttactttttacagacctgacaaattctagagtcttttgcaattttttaaatgtacatgattctgcgcttgaacccaggaggcagagattgcagtgagccgagattgagccactgtactacagcttgggtgacaaagcaacactctgtctcaaaaaaaaaataaataggccaggcacagtggctcacgcctgtactcccagcactttgggaggccgaggtgggtggataacaaggtcaggagttcaagaccagcctggtcaacatggtaaaaccccatctctactaaaaaatacaaaaattagtcaggcgtggtggtgggagcctataatcccagctactccggaggctgaggcagagaactgcttgaacctaagaggcggaggttgcagcaagctgagatcatgccactgcactccagcctgggtgacagagtgagacttcgtctcaaaaaaataaataaatgaaaataaacaaatgtgtatgattctacacatctagttttaaaaacgctttcaacaaacacatacatattatgcaactttacgtaactttttctatgcttgccaaaaaacaacaagatgtacctatccacagatgtggctgtgcagtaagaatcctaacccaaacagatgtttggcctttgcccttggttcctgggaggtaatcctttcttttcccccccttcacatggtccaagatgagactgggaggtaacctctaagcccttagaacgtccaccttatgggagcagtgactcacgcctgtaatcccaacactttaggaggctgaggcgggcagatcacaaggttaggagttcgagaccagcctggccaacatggtgaaaccccatctctattaaaaatacaaaaattagccgggcatggtggcacacgccggtaatcccagctactcaggaagctgaggcaggagaattgcttgaacccgggaggcggaggttgcagtgagcccagattgcgccattgcactccaggctgggtgacagagcaagaatctgtcaataataataataataataataataatgtccaccctgttaagtgcttttgtttacctgggggctttgagccactccagatagttttgcactgtgatttaaggtgaagggctttgagccatgtattatcaacctcctgaagggctgaaaactaaaggtcaaccatgccaacagtcaatcatatctaagtgaccaagtcccagtacaaatgctggacaccaaggcttgggtgagcttccctgataggcaatctccatgagtagtgtcacacatcagtgccagaagttggcaccgtccataacttcgctggcagaggataactggaagtttcgtaagtggactcttctgtgtgccccatgcacctcttcccttggctgattttattctgtatcttttcactgtaataaatccaaccataagtaaaagccctttcaggagttctttgaacccttctagccaattatttaacctaaggatggtgtggatccccaaacttgcagttgatctcataagtgagggtggtcttgggaccccaactccacgatggcaaaacggcactgtcctccagtattcattcttctttcttacttttagtaatggaacacctctcccgcccctcttagcaggaggcagagtgggcaaccagagactacatttcccacgctcctctcaaaatcgggggtggccatgtgactaagttctggccaaggaggtatgagcagagtgatgtgtacaaaaatatgaaccatattcctaaagaaagctgtttacttctttttctgggatgcagttgtgaggtaacccagcttcaaccatgggaataaggacaataccctatggaagggctaagcacacagagaactgtggaacccctaaaacactgaggtgctcacctactacggactgcctatctacctctggactattacaggagaaagaaaaacttaaaaattgtttgttccattgtattctgaagtccctgttacagcagcttagcctgtaccctaatgcataagtacatctgagcattttaatatgattttgattcaatatctatataaattaaaaatagacaaacaataagatgtactgtataaaaaatatttggatatattaaacctgaaaatgtataacaaacatttgtatgtcccagtttgaggctgatctgattaaaaggaaagcgtctatcccaaacaattcaatacaacaaagagttttctcttattcttcttgttattcataactaccaaaaaaagatgcttgatttaacaaaatcaatagttaatacaaactgaagggggcttcctgaaacaacgactaatgcttttcttcccttcaattacagatttccatagaaagggaaagaagtagagacactgttttaataaagtacctaggaggctaggcacagtggctcacacctgtaatcccaagactttgggaggccaaggcaggtggatcacctaaggtcaggagttcgagaccagcctggccaaaatggcaaaatcccatctttataaaaatacaaaaattagccgagcgtggtggtgcacacctgtaggtagtcccagctactcgggaggctgaggcaggaggatcacttaaacccgggaggcagaggttgtagtgaaactgagatcacaccactgcactggccaacactgagactctgtctcaaaaaaataaaaaatagaaagtaccaaagagaactgccttctctagttttccagagtgcggccaaatcacccactttccaaacaccttcccctcaattttcctgctttcctgtgttccaaaccacatggcccaattgcatttattaagcatctccactaggatgttctacacatctcaaagtcagcatgtccataagcaggatcaagctacgaaggaacacaaaagaatgttctagagatgacatgataaaaattaagagtctagaggaaggaggaagaagccactgatcttcactaaggagaagtggtataatctcacaggaaagccaaatgattatctgtagaaaagttcaaggttgcaataaatcagggattccaaaggccacagcagaagagctagtaacaggaagaacagaacttagctgaagaataaaggaaataatatcaaagaagagggaaatatatctaaagcagtaattctcacacgtgagcatgcatcagaatcactagcacagggcctgttaaaacacaagatgctgggccccaactccaacgtttctgattcagtgagtctagggcagggctggaaatttgcatttccagctggactgcggcacacactttgagaaccactggttttgcctgtacctaaaaatgtatctatagtggtgataatagagaaaaggacagttcagtggtaacgagaaaggttatatacagtagagagaatgatgctacaacgtgtcctaagtagaatgaatttcacatcaggagtaatgcaattcaccaggtgaaggttttaattagattgcaggcgacaggctgggcacagttgctcatacctgtaatcccagcactttaggagaccgaggtgggcggatcacgaggtcaggagatcgagaccacactggccaacatggtgaaatcccgtctctactaaaaataaaaaaattagccaggtgtggtggcactcccctgtagtcccagctacttgggggctgaggcagaagaactgcttgaaccagggagtcagaggctgcagtcagccgagattaggctactgcactccagcctgggtgacagagcgagactctgtctcaaaaaaaaaaaaaaaaaacaaaaagattacaggcaacaaaatctcgcctgtcctgccccccacttccccttaccccaaattccaggtctgagctaatggtttttctccattcacttagaatttactataatctatagttttcaaggtgagtaaaatgagaataaaccacaatccaaggttatcagagatttgcatataactataatatgagatctgtaatcccagcatttttggaggccaaggtgggaagatctcttgcgtgagaccagcctgagcaacacagcaagacctcatctctacaaaaaaaataaaaataataaaaagagccaggcatggtggcacacacctgtagtcaggaggctgaggtgggaggatcgcttgagcctggaaggtcaaggctgcagtgaaccactgcacttggcctgggagacagaacaagaccaaaaaagtaaaaataataataataataataataatacaagatcctgcattataggcactaatggaatgcaataaatgcacagagaaaacagccataaatctcatgttcgagaagacacccaagaaagcatcactgagaggtagatctgaactaagaacaatcagtaggattttacaggatagaaggtaggatagaaggtaggtgggaaggggtgacatgaaggcaaagatttcaggaagaagaaaaattcataattaaaaacataaaagggccgagtgcagtggctcacacctgtatctcagcactttgcggggttacggcaggaggactgctcaagcccaggaattcgagatcagcctgggcaatgaagtgagacccttgtctccacaaaaaatttgtttttaattagccagtcatggtggtgcacgcccatggccacagctacttgggagagtgggatgggagaactgcttgagcctgggaggttaagactgtagtgagccatcatcacgtcactgcactcaggcctagactatagagcaagactctgcctcataaaaaatacaaaaagatgtttaggacaacattctagaacttaccagtatgtaggaacatggccagatgtagaggtagacaaactaaggtaggtggagaaatataacagaaggccttgaatatatcatactaagaagtttaaaccttactttgtaagttttaagcaagtgtaaattgggtgggagagtttctggctcctgagcctagcctacaccataacgtataaatcttagcagaagtcctcaccttgtgcattccacccacacaagtcattagatctctgaactcacaaggtaactggcataaacaatgacacataactaaaaacaaatccctcagagcaactgcaattcaaaaatatagtcaaactctttttttctggacctgctatcagttccagcattcacaaatcccttttctcacaaatgcttctattaaatgtaattccaaataaacataaaggaagcagaagttgtcactgcttctggaattttcccttgcttacaccaagaatatatttaaaattatatacttttaaaaaaacaaaaacattacaacatgctacattcttcaagacaccagaagtcttattcaatgtaacaatttagcacactataatctctgaggaacagtgagttccaagataattcaatataatcttcaagtgacaatctgaaataagattaggcataaataatatgcaaaagaatattaacctccaacacagtaaacttgaagtgttagtaactttgactcaagtgctaaaattcaaaacagcaattaagttactgaaacattttacaaccctaacacaaatagattatcaatgcctccaccctacccataaatatctcacttcataatttcttcttccaaataactaatgaataattacgtacatctaaaagtacaaattcaagaccaataccaaaattcagattttttacagccaattattaagctttaaagtatcaagtatacagtttataacccaagctacaaaatttatgtaattaaaacatttaactcaagtgaataacccaagttttaaattatattgtatcaataaaaaaaatgttatgtagtaattctcaacagaaggcaatccttctatccatattcaaatgcaacctgttccaatttttaatacaacagaggtaactgggttactatcactactactagttttagctgtcataaattgagcaagtgtctgttctcacttctttagccagcattgtgtaataaagaatttggggcccaggcacagtggcacatgcctgtataccagcactctgggaggccaaggcaggaggatcacttgaggccaggagtctgaaaccagcctgggcaacatggggagatccctacacacacacacacacaaaaatttaaattagccaggtgcggtggtgtgtgcctgtagtcctagctactggggaggctgaggcaggaggatcactttggcctgaaagctggaggctacagtgagctatgatagcaccactgtgacacagtgagaccccgtccctaaaaaaacaaaaacaaaaaaatttgactggccattgtctgattcctggaaaactctactcttggagtctcccaactgataggagtgtctttgttatccatgaatccataatgggtcctccttggcccacagctgagtttctattaacagggtgactcccagtaggcccctagtttcaggatggggcctggccatgctggaaatgccaaccatgtgaatagtgggttgggctttgagcaacctgacatcagcctaacaacttgacctccagggagaaggggactggggactgagttcaatcatacctatgtaataaaagtcccataaaaactccagatgctgtagagtaagtgaggtttcctggctggcaatcattcactgctgtactggaaggatgacacgtcctgaggacatggaagcttcatgtttgggaccctcccagatcttgttctatgtgtctctttaattggctggtcctgatttgtatcataactgtaattccaagaacagcactttcctgaggtctgcgagtcattctaccaaattatcaaacgtgaggtgtagtgggaactccgaaagttgtagccagttggtcagagtgtggataacctgcaagtcctggagtttgtagctaatataagaagtgaggagagtcttgcagactgtacccttaacttacgatgccttacctaactctgggtagcaggtgcccaaattacactacagctataaaataggatatgctgccttacttctcttcccaggactcttaagagaattaaatgagaaaaaagttaggtaaaagcactctttaagatataaaacgttgtgtttgcttcggctgcacatacactaaaattggaatgacacagagaagattatcatgagaaaaaattctgtattaaaaaatttacactttgggaggccgaggcaggcgggatcacctgaggtcaggagttcgagaccagcctggccaacatggtgaaaccccgtctctactaaaaatacaaaacccagctgggcgtggtggcaggtgcctgtaatctcaaccacttgggaggctgaggcaggacaatcgcttgaacctgggaggaggaggttgcagtgaaccaagatcatgccatagcactccagcctgggcgacaagggcaaaactccgtttcaaaaaaaaaaaaaaaaattttttttttgttacggtctttaagatattgaagaagaaattgttaaaacatttgtaaagttcagaactgtccaggttaaatgctttaaaaaaaaaggcttaaaataaaaagctaaggagtcatcaagaaattgaatttattatgagtaaaatacagaacttaatgaaaaccatttaaaagagcaaaaaatctaagtagtttcaactacataactcagaccagtgcctaaaagataaaaatgcattaagtccattcctagaaatagcaaatgtagaaatgatggagcttagagaatgtaagatgcagccattattttgtgactaaacctccaaaaagttcattttagccttgggtatgatcaggaatgactgaggtcagtaagcaacactttgcttaataggctatgagtttgaatacgaactactcacatcacaaccaactttttttgcccatcactacctaatattttaattcaagcacaaagccatgggacccgactagtctttaaaaggtttctcaaagcatcctatgtggataaggcagtctcctgcctatatgagaaagtatcattttcaactgcattataatagaggacaaaatttttttctattatgttccaatgataaaatcaagactttaaatcgtaattttacaagaacatatcgttttattttccaccctcttgaatatgagatactaagtgttgctggtctttccctcagtaatgcagggaacagtttggtgtagcagggggaaaaaatggccttggggggaaaacctagggtctcatcttatttctcctctttagcaggcaaatgactcttggggtctcactttcctccagtaagatataatggcattgcctctggagtctgtaagattcttcctacccctgacattctgaggtgttgagaagccaataactcataatttagatattcttacaaattaaaaaagccttgcaaggaaatgtcagaaaccattaaaatttatgtaaaaacatcccacctatgtgttcctccttattgaaggagatccaggtaaagatctcctatgtaggctattatccttagcaaactaacacacgaacagaacaccaaacaccacatgttctcacttgcaagtggcagccaaatgatgagaactcatgaacgcaaagaagggagcaatagacactgagtctacttaagcgtggagggtgggaggagggaaacgagcagaaaaagtaactattgtgtatcaggcttaatacctgagtgatgaaacaatctgtacaacaaacccccatgacactagtttatctatataacaaacattcatatgtaccccagaacctaagatagaagtttaaaaaaaaaattgccccatagtcagcaggaaacacatcactagtaacttttactaaatatttacttgctacctccaatttagccctgagcaaacttaagacatttatgttttcttaaatctaatgtattatatgcaaaaccttttcaaactatttacaaagctgaagcaccaagacacatgattctttgacttatttttaatgacttttaaatatgagaaaaacattaattacgatgcaagtcatcatcctattaaaacatttcacttataatacaagcatttaagtatagtagtagtagttaaatctaaaaaaaaaacaaaaaattagccataaataatgatgaagctgccagtagttaacaacacacactcacaaataatgagataaatttaacggcaagcttccaaacaaaaaccttgtcattttaaggtgtcccacagcagaccggttatgacctcgggaactggcctgaaatcttgcctcctttcttgtgtaaccagccaaataacaacacctctctaaatctgtttctttataatggtgccaaccttatacggtagctgtagatattaattaagacactgcacctaggaaagagcctagcacacagtaaataataactcacaattattaaattttggaagaaatgttacacaaagcagcagccctttgacttttaaaaaaaaatttacacctagggtttaggatcctattacttgttaaagttcagactgagaaatgaaataacaatcctacaaagaagcattttactaaggacaagtgaatttaaaataactggtattatgcaagttcaattaccacaggcagaatcttagtttatgagaataattcaagttgtattagctgaaaatatctattattacaaagtcactgtctccatcaattctttcttctcttatttctgtatctgctaaagaaaaataaatcattatgaaaagaacagaaagatacagagcacagctgggttactttaagttccaattaataaccaaatataatctgaggggaaaaacccagtgaaagaagggagaaactgaacacaactaaagatgataaaaatttccttcccaaatactacaagactcatatttcaactggatcttcaaggactttcctgtctgaagacacgaagcctccagcaagtcctttcatcaccacaatcagatctccagctgaacttcaaagggaactctataaaagccactctggtgggcggttgttgagataatcactcttagcatcttctacagattgaaaaataaaaaacctgacttacacattaagaccaaacaccagtcaccattctcaacagtttattttttaatttgctctagacatccacaaaatgtattttttaaaggcgttccataaatacaattttggtggctaacaaaaattcagcaccaaagtaataaatataaaatttagccagacacagtggctcacacttgtaatcccaccattttgggaggatgaggcaggaggatgaggcaggagactgtagcccaagagtttgagaccagcctgggcaaaacagtaggaccccatctttacaaaacattaaaagactagccaggcatggtggcacatgcctgtagtgcaggctactcgagcgcctgaggcgggaggctggcttgagcccaggaggttgaggctgcagtgagccgtgatcacaccactgcattccagcttgggcaacagagcaagaccctgtctcaaaaaatgttaaaaaagaaaaaaattcaattaacccacctttatctcatgccaaaatacaaaatcctaagtgaacaagctaatttcaaatagttcctagaaggtttaaaatttccctgttctgggctgggaccagtggctcacgcctgtaatcccagcactttgggaggctgaggcgggcggatcacgaggtcaggagaccgacaccatcctggataacacggtgaaaccccgtctctactaaaaatacaaaaaattagccgggcgtggtggcaggtgcctgcagtcccagctactcgggaggctgaggcaggagaatggcgtgaacccaggaggtggagcttgcagtgagccaagatggtgccactgcactccagtgtgggcgacagagcgagactccatctcaaaaaaaaaaaaaattaccctgttctaagcactttacatacattaactcaattattactcaccataatcctgtgaggtaggtattattacagtcatcctacagatgagcagaactgaggcaccaccaagttattaacttgcccacagtctcaatcagtaaatggtgggagccagagaattctgaccctagctgtctgattccagagccaatatttaaatcaactatactattcatttactcaacaagttttactgacagcctactatgtaccaggcacagttctaagcactggggataaagctgtgtacaagtcagacaagacctctgctcgcttgttgagaacagggctggcagcaaacaagtctaaggggggaaataaataagtgggaaaaaaaaaacagtgtatcttcacctagtaataaatgctatggagaaaaagagaataaagaataaaagattataaaggaaggggctggttcctattttagaattagaaaaggcctgaggcgatgacatttgagcagaaacacaagacaagacatgaagagccttgaccacttagaggaaggggtggtccagctaaaagaatagtaagtataacatcctaaggaagaaacactttgttcaagaaccggcaaaatgactatgggactggggtaggttgctgaaagtcagtcacctagtaagaggtaacgttagaagctggcagctgccaaatcatgctatgccctgatggcgactaagattcaaatgtaagtggttcacaggatgcttttagaggacactaagcaagaaagtgacaatctgatttacatttttaaaaagatccctctggttgtcaaggtgaatccctagggaacagtcagggagcaagagaaataaaccagtaaaggcactatggaaacactccaaccaagagataatggaacttagactaggattcatgtactgtttataagtagatgctaacagaagagcctgcaacctaattgcctctaaagagcctttttaatatcccttttcccgtctcgtctcctgacttgcctttggaaaaaaataagattattttttaatgtccatgttaacgcttcagttggtgctattatagtaaaaaaaaacttttcatttttaaatgttctgtttaatatactctatgattagtaatacgccacatatacacacccatacattcttgaaaagcagaaagacccacaatgctctttagtgtaggacttgttcatttatttggagacgagaggtacctgtcacctcttctgattacctttcctctcacgctttgtctctagcacatcctggctcattctagattgtgaactgcaataaacaggtataccaaagggaatatgtatttactgagcacctcctgagtaccatggtgtcactagatgtctcacgtttaagaactgatttaatcctcagctacccaaggtgggaaatggtatcttcattctacaaacgagaaaaaatcagagatactagtaacttaacttgtccagtcaccagctaacaatttgtagggccagaaatctaacctccatgtaactgtgaacttcctgtctttccactacagcagctatcaaagaaagtgctttcaaatatatattatatgtagtcactgcaacttcttatgaataatgaccagtttgttgctggtgaggacaacgtttccttaatgctcttatgtagaatcagagttttgaagttgcgagtgggaagttggaaatgtagtgatcttatatattcaagcacattattttttaaaaattatgttctacttgagacctcatagaaattaattttaaaagagcaattcccatctttacaaaaaaaattaaatatgtacggtttaccgtaaaatagcggttaaggttctacaacaaaagataggagtttggtacagactctaccctcaaaaggtcctacacagtaagagaagacagggctaaaaagataaacgcaacacaggaaaaggcgcaaatagcctaagaattgaatggaagagagccttgtatactggagaatgattcctggaagaggaactttaggtgagctcttaagtgtccagtacaggaaggcagggaacaatacgcagcactggtccctgcacgggcaaacccaagaatatgtgtgaaaggttggtggacagatagatggttcccacaggctgatttgctacatacagaactccatagaaagaaccaaggttatggttggtcctaccctacctaaacaggaaatggcttattctcggagactaaagtgccaagtccggaaagaccagacagatacacagaattacagactgttacataaagtccttaatagttacaagcccttgttgtgctatgtgctagtctgcattattttcacctaaatgaaaccatttctacttagtacatggcgtgagaagacgtggagataaagagaattagcagacgtatattatctgcaatttatcttacggaggagtacattaaggagtgttatgtgagattatttctttacaaactgagaataggtaggaagagcagcgaaacacagcgcggctcggtgcgcccagagcggcgtcactgtaacagtacagaagtgggcaaggggctctcggaaggacagttggggaacggcgcccagcgtatttagcgaacggacaagcagcaaggaaaaacaagggagcaacaaccgccttcggacattccgaccggttctgggatgcaccggggacgtcgaaggcggggtgcggaaaaacgctgtggctggagtgcgggtgggagcggcggctcgaccgggtcgacattctacaaacgcttgtggaacgaacgcccgaacgcgcgcgtgaatgaatggcgcggaactgaatggccggccgaggcgccggcgcaggaggaaggagtttgcggcgcggtctgaccgggccggcgggatgcggccgggcgcggagggaagggccgctgcgccaggggtcggcgcggggcggcccatggggctggcggcggcgcggggccggccgcgccatgacggaagggaaggggaggggaggtcacacattacataacccggcggctgcgagcgtcaggggaaggcgccgtggacagcccaggccgcgacaggacggccgcgggccggggccggggcgacgcacccctcccccgcgccacctcaggccgaccgcgctctggccgctgccgggcgggtctgcggcgcctccgggcgacgcgtgtccgatcccgcccctcccccaccccgccgccggcccgggggtcgctcaccttccgcgttgccccagaccaccatgcccgggcccggcggccttctccggccttgcggaccccggccccgccgccgccagtgccctcgccagggaccagggaggagggccgggggaaggcagccccaccgctgagcagcgccgcggtccacgctcccccacgctcgcggcaaccaaccccgcgcgcgctccgcggtggctctccgcccctccccctccggttagcgcgcgcgccgcagccacgccccctagcgttccgcgcgcgctccccggccccgctcgcgctcacagccgcgcggcgcacgcgctctgctccccccggcccggggcgaccccagcctcgggcgtagcaccgcggcgcccggcgtcggcctccgtgttcctcccctccccggccccgccctgttgttctgcagccgcccgcaaggggcagcgcctgggcggcacgtgaccgtctcgctagctgggcggaggggagcgcagcgcgggcccgcccacgcactgcgccgcctgcccgcccgtcctgctccggtcacccccgcgcttcgttgaccgggtcgcggctcttcggttgccattcggacagcgcgccgctccgtgcacagcgagtccccgcgcctgccccgccttggggctccccagtggggaaggacacaagtgcagacactgaccgggcttcaaaccccggtactgtgtgaagatgcgccagacgcccgggttccctccttaagcaattgatttacagtgacatctagtggagaaagggacacacatgaactgacattttcctatgtccagagcaaccgagaaccacggcccactcaggttcgcgggaaggagcactgcgccacggcgttttcgggattcgtggcctgctcccgcagggcacagacactatcttctgtcctttgagtgcccgggcagcattgcgcctgagtatttgtaaacggagggccggtatcccatcccatgtacagcgctggagttacccgagaaagcagttttctatgaatataaaaataatatcctatattatgtatgcgtaagtacaattctaattgagggccttctagcagaaaacaatccgtccataaggaccactttctccctcttggcagggtcgctttgaagactccacattgttacataatagtctttattgttgtaatgcacaaacatgaagatacttttttcccactcattcccttgcctaaaatgcttcagagtttgcaggtacttaggaaacaatcagtattcttttgaaaactgatttgcagagttggaacttgtttactagcaacacagagaatactcaaatagctcatttctttccctttcagttttttgccattttatagacttctataaatgcacttcaacttcagtattctcgtcgctaatccaacgaatttagattgcatacttttcaaagacgtcataatttaaaacaaattgcgtaattgctttcttttcttttcttttcttttgagacgaagttttgctcttttgcccaggctggagtgcaatggcgcgatctcggctcactgcaacctccgcctcccaggttcaagtgattctcccacctcagcctcccgagtagctgggattacaggcatgcgccaccatgcccggctaatttttgtatttttagtagagagggggtttcaccatgttggccaggctggtctggaagtcctgacctcaggtaatccaccagccttggcatcctaaagtgctaggattataggcgtgagccaccgtgcctgcccataattttaacagactcacgaccagttgccgactgcaacaccaggaggtcatctgctgagatgctacagaaaaacagtggtaaccccttgttatgggtgagttttgttttggttgttgttcttttgcttgttttaaatgtctaaatggcagcattcctgcacgattgtatttcaattttcttttccactctcgtattcaaaccgaagatctttttttttcttctttttgtatttttctcaaggaagaaacacaaaccttgagccaactgaccttggcaatacctttatagaatacagtaaaatggtattaactgcaaactagtaggcagcctctgtaaaggacgaaaaaaaatcacgttgctgtctacataaaataggataaaaagagagatggggaatacataaataaaaatgtatttatggacaaattctagcatccttgtgacagggtcttgctctgttgtccaggctggagtgcagtggcaagatcatagctcagtgtaacctcaaactcctggtcccaagcgaacctcccacctaggtgttccaaagcactaagattacaggcatgagccacctcacccagtccaaagttttatttttgtccattccagaatattatgttttatgccatcacataatgaagtcctcttgtttcaatttcatgcacctacatttattcacccacttatctatttatatttattctcataggattatctttctcatgtaaggggagtcaggctgacctttgggccactctgggggtctagagatggccgcgctggacccctacacttgggggagtgctttggggcactgtaccttatttccgttttctgaacctcattaaaattcatttcattactgctatctcaaaaggcctatgaaagtgccaaccactgacctttggagggacagccatggataaggacatgacttctgtcctttcacctctgtatctggcagtaaactttccttggaaacatttacatctagtctctcaaataccaaaaacaaacagcatgaaactactaaaaacagaggtttgtactcaagtcccttggctgatgtagacacaataacatgtgatttactccataggaaagagtgtgctgattgtaataaggattcagtgcattatgctgaaagatgaaataataaggcagaatgatctcacacccacagaaacttaggaaattggcagtggaattggttcaccaagactgaactctttcaaacataccatcatgtttgacaatatgactgaactctttcaaacatacatggacaggtgtatatatctgtatttaagcaacactgttcacagattttaggatgatgcaacaatcagttatcatgtacattctatatgcctgtccctgtgccagaccctgtagggtcaacagtggacaaaatacattgcctgcccccaaaaagctcccagtgtagtgaaggaggcaaacaaacaggtacctgcagtacaggctcagggctgttacttgagggcaatctatgaagcacacaggacaggtgtcagggaggcttcctaaaaatgtgacatctcagtaagttctgagagactagtccagttggttaggaaatgccatttccagagggagcgagatgtgcaaaggcagagaaaggagagagaacagggaacattttagaaactgcagagtgcaaagtgcagagtggtgtgggctgtggggaagggtccatgttgaaaagggaggttggggaggcaagtagggtccagcgcatgaagggcctggtgttagtctgttctcacgctgctgtaaagaacttccctgagtctcagtaatttataaaggactgaggtttaattgactcacagttccacatagctggggggggcctcaagatacttacaatcatggcagaaggggaagcaggcaccttcttcacaaggtggtgggagagagaagagaaagcaaaggaggaagacccccttataaaaccatcagatctagtgagaactcactcattatcacaagaacagcatgggggaaaccgcctccatgttccaatcacctccgtcctttgacatggtggcgaggggattacaggtccctccctcgacatgaggattaaaatttgagatgagatttgggtggggacacagagtcaaaccatatcaggccccataaagtatcttactgcattttgactgtattctgagggtgcaatgaacccttgaaaggttttaggcaataaagtgagttttgaaagtctctctggctgatgcatggagaatgggtttgagaggtggtcacggggtcttgcaatagtccatgtgtacaggtgcagcctagagaaattagggggctagatttcaccagggtagggggtctgtaaagcaatataatgaaacaagaagaaggcaaggaagttgagggtgtaggcaagtgggaaatcataatgattgattgtggaacttaagctgaaggggagagagcacatgccaagggtaggtggaggttgctgaaagatgatatcaatgggcgggggctgaagggcaggcatggaggttgtttgaaaggctctttggagtcaggtattaacattacattacatgtggcaatgacaagattgcagagggagttagtggctgagatacaagggaggacaaagtcatggaagagagaagttcaaggatatgaggggccagagtgagagaaagatcatctctgtgtatatcgaaatcatcaagaataaagactggagtcgtgttggagcaaggggcagtgagccagaatacgatcttgatggctccaggtcagaaggatgaacatcattcagtatattccattctaatatagtagtggtcttaggacagaggttcccaaacattctctgttcatggcatccttagtacctcagtaattttttcccagcatccctaagagttttgccaaaagctatatctaacagttttgcttattaaataggtagggccaggccaggtgcggtggctctagagtggtaattttttttaccaagtggatatcctcttcagcaatctttcaccatatggtttcagcatctattaatgattctggcctgaataaaccattttattgatgtctcagtctattttgattgctgtaaaggaatacctgagtctggttaatttataaagaaaagaggaaggctgggcacggtggctcacgcctgtaatcccagcattttgggaggccgaggcgtgtggatcacttggggtcaggagtttgagaccagcctggccaatatggtgaaaccccatctctactataaatacaaaaattagctgggcatggtggcaggcgcctgtaatcccagctactagggaggctgaggcaggagaatcgcttgaatctgggaggcggaggttgtagtgagccaagatcctgccattgcactccagcctgggcaataaaagcgaaactctgtctcaaaaagaaaagaaaagaagtttatttggcttacaggtctgcaggctgtacaagaagcatggctctggtatctgcttttggtgagaacctcactcaggctgcttccagtcatggcagaaggcaaaggggaaccagcatgtcattccaagagaggaagcaagggagagcgaagtcccaggctcttttcaaaaatcagctctctcaaaaactaatagagcaagaactcattcatcactttcaggatggcactaagccaccaaactgttcttaaggatctgcctgcatgacccaaacacttcccactaggccccatctccagcattagggatcaaatttcaacatgagttttggaggggacatacatccaaactatatctagtgggttgcaaaggatgttttcctaattccataattccttctgcatttattagttggcattcttcaaagaacctcccatactaactgggataaactataatttcttcttaaaaagcagccaagcagagtctcagcctcctggatatcagctattgttcctagatgtgactctgatgggccactttcctacctcttgctgactcttaaattggacaacttccgcctctgactcagcatttgaaattaatttcccatgtgggaatttgcaaataatccttactaacaattgatgtgtgcaggacggcccagccactggctttccctgataatcacagcgatgaccccaagaagtgcccaaagtttggttatgtgtgactagtttgtgtctaaaaatgagaccaaatggtgcttctaaaaaattccagtgactttcccaaagcttttttgctggtcgttttcacacaataggtgtttcatttctaaattgttgtatactctgatttggtctttctgtgttgctttgtttatcatttatttttcccttcaaggtaaacgtgcttcttcctattttgaaatctttcaagtttcacctatatctctgtttatttgctgaatactcctgagacaataatatctgggcttggcgctctgcttggctgaaatgcattctgcctgttaatcatttctactatcagcaccctttaacttagcctcctggatatccgctattgttcctagatgtgactcttcattttggcaattctctactctctccctctgtgagtaatgaaattgtcttttcaaaatctagtctgtctttatctcttttgtactttgaacccttctttttccctgtgtaataatattttatgtctgtgtatatggttaaaaagcccatgattatgaatactgcttgcaatattgagcctcttgatttttaaaatattttcctgattaaactcatatatcatgattaattctgcttgtcttttataattctcttatctttattctggcttcttcatattatttttcttaaaagtccagaaacaaaagtcttctctattgttttttctttctctttctttccttctttctttttttttttttttttttttgagatgaagtcttgctctgtggcctaggctggagtgagtggcatgatctcggctcactgcagcctccacctcccagggttcagtgattctcctgcctcagcctcccaggtagctgggattacagacacgcaccaacaagcccagctaatttttgtatttttagtagagatggggtttcatcattgttagatatgagttctaaatgtcttttcaaagaatcaatatgtcagtatgttcaattctttaccttctacttttaaacttaacttcctcataaagcaacctgttccatcctgattcatttcaatcagctgctccaccccgactcattctgattacctgctctgtcataaccatttttcctgccaaaccagtcaccccatcactctctttaaattagccaatcggaattagtttagcctgtgtggtctaaccctagccaataggggaatgacacagcaacaggggccacatgcgtcagggataagaaccccttcccctcccttgtccaagtgtgcgctcaccattgctccatctctaagggtgcacccttctatagaagtaccttgccttgctgagaattaaaaagaaaattttatattcaggtgctatttcttttgcggcaccaaaactttatatataacactttgggggctcacccgtgattacattcccctcctgggacggtctctggttctctctcgtgaggaggcatgcgtcccgccccttgtggtggcctcaggggtgagaaatcagaacccacccagtgtgaggaataacccagctctcagcaatgtggggggaaagaaaaaaaacaaaactggccagcagtgtagcttaaaggatcctcacaaactgtagcgatgactctgtgcacagcccaaggaaggagaagctgcaggagccggtaaagtatttccctggtgttcgggaccaaggtaagaaagcttcaggaggtgtagggggtgaggtactccttggtcgggttggcttagaggttaaaaaagaggcaagacatccccattgggggcatttaacttcacacaaatctccagtagtacaaaaggtaagaaatttccagtggggaaattgagcctcaccccaaaaggcaagaaatttccagtggggggagcctcaccccaaaaggcaagaaatttccagtgggggaaattgagcctcacaccaaaaggcaagaaatttccagtgggggaaattgagcctcaccccaaaaagtgagaaatttccagtaagggaaattgaaacttgaaccttaccccaaaaccatcaagatgggaaataccccaagcaagacagggagcaaggggaataaagatggtaacaaatatatcccccagataacaccctaggtctcatgctaaaacactggaaagataatgaaaggatgaaacataggaaaaagcaacaaatgataaaatattgctgttttatttggactcagggacccatcctcagaccctcaattttctggccacagtttgggtcaaatgaggatgtaatgtgtcagcttctaatctgatatgttaatgataaaagcccagtgtctcaacaagaactaggctatgccctttgttggaggcaaggacctgccctccttttcccttaaaaacaaatagggaggaacccaatctggcacctcaaaatgaaaagtcagaggagccagctctcatgcctaaagactccagcgcatgggatccctgagactatctcccccactcattgtccccaatctttcccctcagacagccactactgcctcagatcccattccaaattccccctcttctcacgttatccctccttcttataaccctgacacttgggaattaccatcccatctcagcctgttccttcccaacctaaatacccctttctaaaaggactccagcatgaagtagaactatgtaaaaaagatattcagaatttcccatttccctccatacctaagaggtcagccccgactctcttccctttgaaagaggtaccacaaggagggggcaccattggctttgtaaatgctcccttaaccagttcagaagtctggaatcttaaaaaggagcttaaaccgctagtagataacacttatggagtggcagaccaaattgaccaattcttaggacctcagttgtacacttgggtcgagttaatacccatcttgggcatcctgttttcaggggaagaaagtatgattcgtagggctgctatggtagtttgggaacgtgagcaccctcccggtgaaaacattcctaccgcggaccagaaattccccgcccgagacccctggtgggacaataacaacgcagatcaccaggaaaatatgcaggacctaagggagataataataaaaggaattcgggaatcagtaccccgaacccaaaatctttctaaagcatttgatatacaacaggaaaaggatgaccggcctatgaaattcctagacagactgagggagcaaatgaggcaatatgcaggcctcaattggatgatccccttgggcaaggaatgttgaaactccaatttgtcactaaaagttggccagacatttcaagagttacaaaagatagacaattgggaagaccctcccctaagtgagcttctcagggaagctcagaaagtatacatgaaaagggacgaagaaaaacagaaacaaaaggtaaaatgtatgtttccaccttccaacagatggctccaaacccaggtacttctagacagttttcagggagccagaaactataaagggtctgaaccctcttttaaaggatcccagcttccatctggaggaccagggttctcgtctaccaggctccctaaagagtatgggggagaagggttaaagaatcccagaactaagagggaggaaggacaagataggtgctatagatgtggaagaacaggccacttcaagagaggatgtcctgaactaagaaaggagaaagaagcccttccactcatgacttttgaggaagaatagggggatcaggggctctgtctcttttatcttgagtcccaccaggagcccttgataaatttggaggtgggacctaaacatgagcttatcacctttttagtcaattcaggggctgctcactcctctgtttgtttccccccgtctaatgttgccacctcctcagaggaacttttagtctccaggataaaaggggaaggagaggggagaacagccgcataagcagctggcagaggcaggaaagaccagcagagaggaaagagagcgagagagaggaaaaagagagaaaaaggcagagagagaggaagagacagagacataaagagggagtcagagagagaggaagagacaaagagggagtcagagagagagaaagagacagatagagaaagagatagaagtagtaaagagaaaacaatgtacgctattcctttaaaagccagggtaaattcaaaacctataattcataatcgaatgtcttccccgtgacactataacactccaataccactttgttgtcagtgttaacaagggcatagcctgaaagcactgaggctactgatgacccgtagcctttctatcaaaaatccttaagccagtaacccgcggatggcccaaatgcattcaatctatagcggcaactgctttgctagcagatgaaagtagaaaaataacttttagaggaaaccttactgtaagcacacctcaccagttcagaagtatcctaagtcaaaaaaaaaaaaaagcaaaaaggtagcttactaactcaaaaatcttaaagtatggggctattccattagaaaaagacgatttaacattaaccactgataattcccttagcgggtttcctaacaggggatctaaatcttaattaccatacaaaggtccaaccagacctaggaggaactcccttcaggacagggggatagatggttccttcctagtgactgagggaaaaagacataatggatattcagtaattaatagggaaactcttgtaaaagcagagttaggaaaattgcctaataattggtctgctcaaatgtgagagctgtttgcactcagccaagccttaaggtacttatagaaccaggaaggaaacatctataccaattctaagttaatttggactaaacaaggtcttattaatagcaaaggataattgaaatcccaaacttacaaggttttcaaaaaagtaaagtttgctaaaagttaacagtgtaacatgtattatcctgacttctaatcttgtggcgttaggcagtctagtccacagacatgaaggaagttcactttggaaaagaatggttatcatctttggaaaaaaaaaagggggggagtggagaatttacgtaaaaagaatgctatatggtaaattattgtgcgaaaataaattaactggttgtttaaagaaagggatgtttgcaacaagacaaagttgaggcatatcgaagaattgtctgtggaagtcgtgaaaaaaaatgcatgttataaaaggggatttatgcaagaaatgttgtataatttaaatgtatttaggtatcctgaatgtaaaactattgaagaaacagtttatgtgcaaggtatataaggaaagtaaaatatacttttggtaaaaggattataaggaggaataagaacgtggatttttacctacatttaaaggttaaaaaattgttttgagggttttaagcaagtttaaaacgttaatcgtaaaggaaattctgtgtgcaaacgtattggctaaagttataagggtatcatccagtttttctgtgaattggacattaaaagcacagcgggtttttcttaaagcactaacctgctctttaacaaaaattataaaaggttaaaaagagtctataaaaatcttaccttatggtcagaagttaaaattagataaatatgtctacaaggttttattaaaattgagtttaacattaataaacactaatataaaggtgaaatttagtttatctggtataaaaatcatacaggaagcattgtaaaatatcaaatggtgtttggctttctttggtctaaaaactaataaaaataggtgataaaggaaatttctcagtaaaaagtcaccaggaactacaaagtccactgctgatgtccccacatttaaaacaaaagattgatttcttagaaattatatacttggtgtatcttccactttccttttcctcaaaactaaaagtcttttagcacaggtaccacccctagaatttctggtaaaccagcaccagcctgaaggtcacgttctcatcaaagagtggaaagaaagaaaactcaagacagcctaggaaggaccctaccttgtgctgctaaccaccaagactgctgttcgtacagcagaaaagggatggactcattacacctgagtcaagaaagcaccgtcccctgcagagtcgtgggccatggtcccaggggaaaaccctaccaaactaaagctaagaaaagtttgactctttcatctactctattactctttcttctttcctagctctattgctgaccatctagttattaacataaccaagttaatttcgcctcaaactgttgcatttaatgctggcctcgttataccctgtgggggcttgccaagtcaaagacagctcttgacttcagaaaagtacctctgtctggccaggcgcggtagctcacgcctgtaatcccagcactttgggaggccaaggcgggcagatcgtgaggtcaggagattgtagccctcctggctaacacggtgaaaccccatctctactaaaaataccaaaagaaattagggcatggtggtgggtgcctgtagtcccagctacccgggaggctgaggcaggagaatggcgtgaacccgggagatggagcttgcagtgagccgagatcacaccactgcactccagcctggatgacagagcgagactctgtctcaaaaaaaaaaaaaaaaaaaagaaaagtacctctgtccctcctgactctcctcagactgggccttagtaaattgggaccatttaatccagggagattttgataaagacccccatgtcaaccaggagtcttgccccccgatatagagcttttatgccctagttggtccaatgttctgtggaccactgaagagcaaagatggactgccccaaccggtttttgtaatttcctaaaaccatgcattcatcttactagaggatcatagaagttaaagaattaaaataaactttggcaattaagacaggataccaacatgcaaatgcctggttggaatggatcaaatattctgtccacacgttaaacaaaagcaattgttatgcttgtgcacacagcaggccagaggcccagattgtcccctttccactaaggtggtcttccagtcgaccaggcgtgggctgcatggtagctgttttccaggattctacagcctggagtagtaagtcgtgccaagctctctctctgctatatcccgaagtccagcaccctgccggtcagcccctgagggccatccagcttctgtctcccaaccctgagttcacttcatgtctctcatgacagggaggaaacttagcattccttggagacctgaagggatgcagtgaacttaagaattttcaagagcttatcaatcggtcacctcttgttcatcccgagtggatgtgtggtggtatgagcggatgtatggcggtattgtggtggacctttactggacactctgccaaataactggagtggcacttgcactttagtccaattggctatccctttcaccctggcatttcatcaaccagaggaaggaaaaataagacatggtaaagcgagagcagcccctaatggatctttcgactctcaggtctatttagatgcagctggagtccacagggaacaccagatcaatttaaaacctgaagtcaaatagctgcaggatttgagtcaatattttggtaggtgacaattaataaaagtgtagattggataaattacatctactacaaccaacagcgatttattaattacactagagatgctgttaaaggaatagctgaacaattaggggctactagcagatggcttaggaaaataggatagcagacatgatattagcagaaagaggaggagtttgcatcacgattaaaactcaatgttgaaccttcatcccaaacaacaccacccctaatgggagtataacaaaggcgttgcaaggtctgactgctccgtccaatgagttagccggcaactcaggagtaaatgacccctttacaggatggctagaaaagtggttcggtaaattcttacttccctcacagccgtaatgggtgtacttattcttgtcaggtgctgtgtcataccatgcatccataggctgatacagaggctcataaaaatggtacttactgaaacctcccttaactatcctccaccttatccagagaagctgctgattttggaaaatcaagcaaaacaactaagccaagacatgttaaaacaagtttgaaaagaaagctgtaaggaaataccaggggaggggttgttagacatgagttctaaatttcttttcaaagactcaatatgtcagtatgttaaatcctttaccttctacttttaaacttaacttcctcataaagcaacctttttcaattacctgctccactgtgactcatttcaatcacctgctccaccctgactcattctgattacctgctctgtcataaccatttttcctgccaaaccatttaccccatcacgctctttaaattagccaatcggaattagtttagcctgtgcagtctaaccctagccaataggggaacgacacagcagcaggggccaagtaagtcagggataagaaccccttccctcccttgttcaagtgtgtgctcaccattgctccatctttaagggtgcacccttctatagaagtaccttgccttgctgagaattaaaaagaaaattttatactcgagtgctatttcttttgtggcaccgaaactttataacaatcatgatggccagactggtctcaatctcctgacctcaggtgatccgcccaccttggcctcccaaagtgctgggattacaggcttgagccaccacacctgggctgtcttttctaaattgaatatatttctgtaaccattctatctttttaaagttatagtaaatgaattgtattatttttaatatttcaagacaacatgatacaatcatttcaactcacctttagtttcaaaatctttaaaatgaaggttttcatacaattttggagctagagaatatgttatgtactgtaacactttcattttcagaccaagactttgaggtccagagaagttaaattatttgtccaaaattaaatagctcattagttacaacgtcagaacaagaagcctggttcctgccttcctgtccagtgctctttctatagcaggactgcatctccatttaaagtgtcatttatatttgaataccatgagtataagtcatcattttcacatcgtgtgtatttttccccttcagtattcataattagaacacccacaaaagagaaatcttccaataaaattggatgtccctacaggtccccagagttgttattgacagagtgaacagtgaaagtccctgggctttatgttctgctctgctgctgatttggtgtataactttgagattatttcccccttgggctttcctaatgtgttggattccagttatagacagaatatctgaaagccctcatctaagtcagtctattgagaaaaatgtgtatactaacaggaaaaatagaaaattaaaaagacagttgaaaaacaagatatacagcatcatttaggaaattaaatttgaggaagtgcacttacttttaacccaggaacttgatcctcatgtctctcacggtggttaagggtatatttctaagcctctcctcttaagtgtaataatcacttacatagattattgatctatcttggccagaaagcacagactctgaacatctgacataagtgttataaaggaccaattaactgacctaagtatgaaaataatcgtttgttaattaaaaaaaaatcaaacaaggtgacttcctgttaaactcttgattgaacacacattagtttctctggccattttcaaatataaaaatgactgtaaatttctttttaataaaagggacttaaatacacaaggaaaggggactgggagaggagaggaaatgtatacaaaactttggaagctggaaatcagaaggtgcgtggccgtatgcttgactgaccaggagaagctggaaccaggacatcactgctcagaaagtctgttaggcaggggacagtggctcatgcctgttaaatcaaatttagcctaaagctgcctccttacatattttaagtttggcttaaagatttctctgtacatggtgaactctaacaagtggaagtgtgaacagaccatagcctacacttgtgccaatcaccaagttttggccaatcaaatgtagccagctgtttgaactgtgttcaaataatgctcacagctcactgcagcagagccatcttcccccaccattctgtctgaagttgctgccaccaccccttggttcactctgcatcacaccaacatccgtatcttctgtctcctcttacacatgcacaggtggtctttgtcattgtcttccctcgtgggaatatgagctcctttcaaagaaggactcagttgtcttgttcagcactatgtccctgcctggtatgctttgcttgcgtgaatgaattcatggtgattatttagttcctactagttcttacaaaatgtattttcttccaaaatgctgccatctttattcccataactaccgtcttggcacaatccctcatctctttactctgaggtaagcacagttgtttctcaattacccagaaccccacatgttacttctagacgattcttcctaaagtaccatctttgttgtgaactctccctaggatggttttgtcgatgcctgtcagtcaaagaccaccaggaacacactgttagttgaagaagttgggtttattattcattgcagtgagagagaacacacgccatggggactcatgggtgtctcagacaaagggcgtgagaaagaacctattatgtgacttggcaggcgtggtggctcatgcctataatctcagcattttgggaggctaaggtgggtggatcgtctaaggtcaggagttccagaccagcctggccaacatggcgaaacctcatctctactaaaaatacaaaaaaaaattagttgggcgtggtggtgcatacctgtagtcccagctactcaggagactgaggcaggagaatcgtttgaacccgggaggctgaggttgcagtgagctgggatcatgccactgctctccagcctgggtgacagagtgagactccgtctcaaaaaaataataaaataaaataaaaaataacctattatgtgacttggctttcgttgagtgatctgaggaaaggcccaaggaagtgcggtatgctctagattggatgttgccagaaagcaggggtgattctatgatttcatgtcttaataaatctttgttgttgttgtggttgttgttgttttgagatggagtcttgctctgtcaccaggctggaatgcagtggtgtgatctcggctcactgcaacctctgactcccaggttcaagcaattctcctgcctcagcctcccgagtagctgggactacaggcacatgccaccacgcccttctaatatttgtatttttagttgagatggggtttcactatgttggccaggatggtcttgatctcttgacctcatgatctgcccgcctcggcctcccaaagggctgggattacaagcatgggccactgcacctggccaatacatcttaactatagggagaggagtttagaactaggataaagttataattggtaaagaagcaacagccactcattggggtgggaaagggggtgtttggtattttgtgattgggagagtgaccttgttttgcctgtgcttagatcaaattaggaagtggccttgctttttctcattttatcatgatctcttaatggctttgtctgagattgggattctgtgagattgtttatacctatctaataggagattaatatgcctagttgggagagtcagacttgcttctgaatgtcaggggctgcctttttttttttctttttttattccttttatttcccttttggccaacggcagacaaagtcagaccacaggacattaatgattatatccagattttcatcattgccaagatattgttgattaagatcagaagattgcttgttgaatgtagcctctgattgatctagggttaatctttcctttaccttctgttgtaggatgagtggctgcacctctgatgagacaatggctgcacagaagcatttaagactctgcacaggatccatcagccaactgcaccacaggccattatcagaagcaaaatgacaattagtttttacattatggtttgaggccaagggcctagattatgaaacccaggcaatgaaaccatgtcccataatccatctgagagagccagatggctttttcttttagcttagtcatttactgttctatttacccagaagtatttatataggtgcagctgaagtgtttgctgtggcacaaactcctgcttggctggctaagagaaaatcaagggctgtacaattgttcatgacaactctagctaatgagcttagattagttcgtttggctccaagagcaggagtagtgttgtttacaactcctgctaaagtcagggacaaatttcaaatttcaagccactttttttttttttttttttttttttttttagagacagggtctccctgttgtctaggctggagtacagtggcgtgatcatggcccatggtaacctcaaactcctaggttctctctcttcctcccacctcagcctcctgagtagctgggagtataagtgtttgccactacacccggctaattttaattcttttttttggtagagataggatctcactttttttttttttttttctgagacaaagtctggctctcttgcccaggctggagtgcggtggcatgatttcggctcactgcaacctccgcctcctgagttcaagcaattctcgtgcctcagcctcttgagtagctgggattacaggcatgcacaaccacacctgactaatttttgtattttttagtagagatggagtttcagcaagttgtccaggctggtcttgaactcctgacctcaggtgatctgcctgcctcagcctcccaaagtgctgggattacaagcatgagctactgcgcccgaccaggatctcactatgttgttcaggctggtcttgaagtcctcggctcaagcgatcctcctacctcagcctcccaaagtgctgggattacaggcgtgaggcaccatacccagcctcaaaccacttttctaattgtattattcctattataggaatcacagcttgcagagtatacatgaagaggaaatgaggtattgctcctgaaagttccctcaaataatttgtgtttgcttcattttgaaggcttctggatatccttcacaaggatataggatccaatagaaggatgatagttttaaatatttggaaatctctgacaattgctctgaatacacagatcagtgatcgtgaggtagggaggtatacacctgatgtccatttaaggagtagtatccttagtgcaacatagactgaattccctcgagattaacaaatcccttgagtggaattaaacagttcctgcaaggcaggctgaagtatctctgaagagaacaaactgtcatgatcaggatagcccaacattagcgtttattacctattgactagactttgctgatacgattgtgatgatctcagtagaaacatttcattgatataaagttaagattaattttttgcaagattagaggttgggattaatgacttgaggaaaactccagcaccagaagggttctgtaaaagggaattttcattctaaagtatttaaaggaacagctgttatatttttgtccacagggtcagttaggggattacagattcagcaatccattggcttcagagccacagctgtgatctgggaaaaacatatgagagttttgctttttattaaggaatacaaaaagatcacaacggtcagaaatatcaggatgggtcaggcgcagtggctcaggcctgtaatcccagcactttgggaggccgaggtgggcagatcaaaagctcaggagttcgagaccagcctggccaacatagtgaaaccccgactctactaataatacaaaaattagctgggcgtggtggcgcgtgaaaaaaaaatattaggatgaaaataagaggcattatattagtgttctagaaggtgttgaagtggtacattagacaacattgtattgttaagggaaatcagaaaattgatgacgaatctgaaaatgtatcttgttccttcatcttcaggagaagctgtccattttggagcttcattatttgttccataatctggggtcagtgctgtccatttctgaagttgacaacttctagagaattcctaagaatcttcagtttaaggcttcagatgaaatggatgtttagtagtcaggaggaagagatgtgtgtttttttttttgagacggagcctcgctctgttgcccaggctggagtacagtggctcaatctcagctcactgcaacctccgcctcctgagctcaagcaattctcctgcctcagcctccctagtagctgggactacaggcacgtgccgctgcacctggctaatttttgtatttttagcagagacggggtttcacagtgttagccaggatagtctggatctcctgcccttgtgatctgcctgcctcggcctcccaaagcgctgggattacaggtgtgagccactgcacctggccaagatgtgaatcttttgaactgggaaatgtgaatcagaggaacattactttggccttttactgctatgttatttgttaatagtacctggtaaggtcctttcattgtgattcaagggcagtctttctctagggtcttttccaggaagactaaacctccatgttgcagattatatagaggttgttcagagggtggtttggaaatgcaccttttgcttgttgatgaagtaattaatcatatctgcctgtagaaagataatgtgttggcttcctaggactaccaaaacagagttccacaaactggatggcttaaaacaacagaatacagttctggaggccggaagcctgaaatcagtgtattgaagagccactctccctctgaaggctctagggaagaatccttcctctccataacttttggtgattgttggccacacttgggtttccttggcttgtagaaccatcactccaatctctgcctccatcaccacatggccttctttctgcgtgtgtctctgtatccaaatttctctctctctctctttttttttttgagacagagtcttgctctgtcacccaggctggagtgcagtggtgcgatcttggctcactgcaacctctgcctctctggttcaagcgaatctcgcgcctcagcctccctagtagctgggattacggtcacacatcaccatgcccggctaattttttgtatttttagtggagacggggttttgccatgttgcctgggctggtctccaactcttgagctcaggcaatctgcccgcctcagcctcccaaagtgctaggattacaggcatgagccaccgcgcccagcccaaatttctctcttcttaaaaagatgtatgttggctgggctcatgcctgtaatcccatcactttgggaggccaaggttggcagatagcttgagcccaagagtttgagaccagcctgggcaacatggcaaagccttgtctctaccaaaaagtacgaaaattagctgggcgtgtcagtgtgcacctgtagtcccagctacttcggaggctgaggcaggagggttgcttgagcccaggaggccgaggctgcagtgagttgagatcacaccaccgcactccagcctgggcaacagagtaagaccctatctcaaaaaaaaaaaaaaaaaaaaaaaaaaaaaagcacgaggacaccttgtaattggattagggcctactgtgatccattgtaacttaatcttgattgcatctaccaagatcctatttccaaataaggtcatattcacaggtatcaggggttaggactcgagcataaattttaggggagacaattaaggtagaatataagattgggggtgaaattcccaaatacatggggcaatctgttattaattcataaagagataatctgtgggttttcagagggggttcattttatagacattaaatctaatggtcatacttcaggctatgggaattaagagttcctgagtgctttgctaattttattttagaattccattagttctattttttccctgagtattatggataatgcatttttgagtaaaagacaaaactttacagagtattagtagtactaataaaaagaatagtactaataaaaagagagataagtgggaatttcccaagtgggaaaaacaaaagcaagatttttttttttttcttagaggcgtagctctctggcaaggagaagattcaaccagctctgagaataaatagacaataaccagaacatattcataacccagtgcaggaggcatttatataaagtccatctggagtgttcaaagggcccttgaggtttggtttctgtccatgtctgatctttacagttttgccaggattgtgtcactggaaggtaggagatgttttggaaacatcctcagcactaactctaaatttagcccgcttatgttagtctaatattgttgccaatttatttctgctattacttgtaatatcatgaagcatctttactaaattccatttttcattttttggcactactggcagatcattctgcaaatgccaaatattatctatatgcaatgagcatcctaattttttccatttgcttttttccaaaccaggagcttgtctctgacagtcaataatagcctttttgaattctccaaggcctctcttttctgtgttattacaggaacaattatgtttggctaatgttgccttttttggcatagtggtcagctaaagcactaccatgagatttgggatccttgcattctataagcagggaagtaactataataaaagtggaaggtcataaatttagggctcagccctaagtttctatttttaaaaagaaaccgtccacaaataaaattacatcagatggccgggtgcggtggctcacgcctgtaatcccagcactttgggaggccgaggcaggcggatcacctgaggtcaggagttcaagaccagcctggccaacatggcaaaaccccgtctctactatagataaaaaaattagccaggcatggtggcaggtgcctgtaatcctagctactgaggaggctgaggcaggaagaattgcttgaacctgggaggtggaggttgcagtgagccgagaccatgccacttcactccagcctgggtgacagagtgagactccatctcaaaaaaaaaaaaaaaaaaattatgtcagggatatctggggaattggtaacaaacctgtataagattcaggtaaatctgtaagacggacttaattgtgaagttctccttcaggtaaaggaaggggagtggctaggtttagagtgttgcagtgatagtgatgtttgaaggtgaaagcatagcgtttgataggatgtcaggcagctagctgagaaatgctgactattttccattaataaaggagtgtgtacatgagaaaccattaagtttcatggagaaactagaactgagccacctgaggcttccataaatatgctggtgctgctatagttcttagacaaggtgactacatcttagctactggatctaatgggaagactgaaaaaagggcctctgatggttgtcaggtaattgggttagtattcctagtgtttagacttttaataacaaaataggaaaagggtttatgataaaaaggtgaccccaggtttggggactgttgcagagacttttttaggtttcggaagtcttattatatgaatcttcctagagtaagaggttcaggatctaaggacttaattcacggaaaggggtagcaatggcagaagaggttggcacccatcacccataatatatagtcaccctaggaaccctcaaagttgctttgtaatagttcgtttgggaaaactgaataatttgtaatttttatgctgcgagagatttgccttcttttgatggtgtgtgccctaaataatgaacattttgttgttgctattgttgttgtagcagaattttaatttctctttgaaggctttatgtctcttctgaatgaaggtctttaataaatacaccaaatcagtcttaaagttttgctcattttttgaacatagtaaaagatcatctacgtattatatctacatattatattagaatagactcacaaggaaatctcaaatccttgcagtcccaattaagaacctgagagaaataagaaaggatcttcagtaaatccctgaggcaaaacagtccaggtacagtatattgttgattttcccatgagaagggaaataaatattgactgcctagatctaatgggatgctaaaaaacataagcccatcacagtgaagtgagtggcttcgggtagtattgaagacaaaatagaatttgaattaaggaccactgggaaaagaggaatcacgatcttatttatggacctctggtcttgcataaatcaatatctatgcctgtgaggtcttttacagagcaacactggagtactacaagggctggtgcaaggaataatgaatgagtccctgtttataaaatcttccatcatgggccttgatgctttcttagcttcgggctttaaagggtattgagcaagaacaggtaaaggtttagaaaagtcggtttctgctttgatgggcttggtccccagaatgcttcccttatcagaactcttgtcccagagagaatcaagtaccttacgtaattcctcatatagacattgggttaaacgtacaaggacaaacaaagtgccatataaattgcattattaaatgattatgcctgggagagtttttaggtgcttttagaaataggccatctgaggaacatttgagttgacagttccattcacacaaaagattcctcctggccgggcatggtggttcacgcctgtaatcccagcactttgggaggccgaggcaggtggatcatgaggtcaggagatctagaccatcctggctaacaggatgaaaccccgtctctactaaaaatacaaaaaaattagccgggtgtggtggcagatgccagtagtcccagctactcaggaggctgaggcaggagaatggcgtgaacccgggaggcggagcttgcagtgagcttagattgcaccactgcactccagcctaggtgacagagcgagactccgtctcaaaaaaaaaaaaaaagcatccctcccaatgcaatatacttgtgtggtgtcacagagacgaaatacatgctgactagtgaagaggccaagaattacagttacaggttgcgtaatgggaagtgtttgagtgctgttttgaaattccagaatagtttagtgactttaaggaagatgagtaggaatcatggtagaatttatagtagacagagtagcacctgtacctatcagaaagatttgctttctccctctattattaaagataatcctccttaatgatttgaaggagaaattgggcactataatattgcccagagtcccttcattattcctatttagaataacagggaaggagcattacttctgtttcattttagttaagatgggttacttttcctagtgctctcccctttgttaagtgcagttggccctctgtatctgtggatgacacatccatggatgtaaccaacctcagataaaaaaatttggaaaaaaatgaaaaacaataatacaaaaataaaaatacaaatttaaagaacaatgcagtataacaacattgtattaggtattataagcaatctggacatgatttaaagtataggggagaatttgtataggttatatgcaagtagtacaccattttattttagagacttgagcatctgtggattttggtgtctgcagcaggtcctggaaccagtccccttcggatatcaagggaggattgtacaagtaagtgtttttgtcaaagggaaggtttttactgtctcttgaggtagaggaggatagaaataattgctttaattgttacatgatgtgctttgtttctgtgtttgttttccttctgggtatctgaagcatcttcaaaatgttccactaaatgttgaagttcaggcaatatggtaatttgtaagccatgttttttgagtttacgttccatatctgtccaacagaaaaggtgggaagggcactagaaatgccaacatcaggtgttaacctagaacactatctaaatgtgctcgttagtctgtcaccaaagtccctttggtgtctcttttgctatttgcaagattgaatcaaggtccagtttactttctttattatttttatttttaaaattaaaacaaaattattgtagtaatagtgttaccattttattttagcaggaaggtcttgtgttataattccaagaggttgtcacccatttgctgtattttaagtactcccaattgagcaaaatgcatttgatttttaaaaattaaattttatgcatgaattcacatgcaattctgagaaataatacagataaatttcatgtattctttactctgtttcctccaatggcaacatcttgcaattataatacaatttcacaagatactgacattgatacaatctacccatcttggtcagatatccacagttttacttgtatgcatttctgtgggtgtgtgtacttagttctatatgattttataggtaggtgtaggtttgtgtattcaccactacagtcaagatatagaacagttccattatcacaaggatcccctttgttgttcctggataaacccatccacctctctcccaccccttttccccaaacttctaacgtctggcagccaataatccattctccatttctaaaattgcatcatttcaaaaatgctatataaatgaaatcctaccgtgtgtaaccttttgagattggcctttttcactcagcttacttctctggagattcatccagttgtagcatgtatcaaatagtttgttcctttttattgctgagtcgtattccacttctaccaattcacccactgaaggacatctaggctgttttcagttcttggctctaatgaagaaaaattgatatgaggatacatgtacatgtttttgcacaaacataagttttcatttatcttaaataaatgcccaagaatataactgctgggtcatatggttgttgcatgtttagttttataagaaactgccagttttccagagctgccgtactgtttaacattcccaccaacaatgcatgagtgatctagtttctccacatccttgctcacattttttttttttttcttgagacagcgtctctctctgtctcccaggctggagtgcagtggcacgatctcggctcactgcaacctccacctcctgggttcaaacaattctcctgcctcagcctccagagtagctgggactacaggcgcacaacaccatgcccagctaattttagtattttagtagagacggggttataccatgttggccaagctggtctcgaactcctgacctcagataatctgcccgcctcggcctcccaaagtgctggattacaggtgtgaaccaccaaggaatcaacttctttcctgatgaagccattgttagttttgagtctctgtcacagcagctgaagcaagatcctagctaatttttgttttgagcctccttcgcccgtgagtgacaaaaattctgcctcagtcaacttgctttccctcagttttttataaatttgaggttcttcatgggacccgggcacttcagggtcctgacagtgtccatctacgcaggctgatcctgctgtcatccatgctggctgccggtccacatccatgtcctcccgaggcccaggcacctccacacttttcctctctgggtttgctgccttcgtgggctgtgttagggaggagggcatggccactttctgctcttggctcccacacacgtgtctaggggttgcactgtctgtagggctctgacctggagccagttcctgggccctccctggaacccgtgtaagtcaacactcataccatatcctcagccacacttccctcagccagcctgggatcactctctagcctccagcgaggcaaccactctcctgaaagcctacactcctactcttgttaattttagggctgtgccctaaaatcctctccccttccctgggggttttggcttttgggtttccctctcttttagccggacacatctttctcgtgagacgatgagcacagaatattgagagtgcttgaattctaaggtgaggacaggtgataagtttaaaaatgtgggaaaacaactgacaaatacctcaaaaagtattattctagcagaagaggaaatatttaattccttattgattctgctgatattctgtatacgctacctaattcttctcctccttcccttccttcttttccccttcttcttttttttttttttttttttgagagagggtctcgctcttttgcccaggctggagtgcagtgtcacaatcttggctcactgcaagctccgcctcctgggttcacgcccttctcctgcctcagcctcccgagtagctgggattataggcgcccaccaccatgcccagctaatttttatatttttagaagagacagagtcttgccatgttggccaggctggtgtcgaactcctgacctcaggtgatacgctcgatttggcctcccagagtgctgggattacagccgtgagccactgcacccgatccagagtgagttttgaaagctgataaggaatcggctgagggaaattggagaaaagtggtctagggagtgggaagagggtacaccaaggcatggagtcactcaagtgtggcttgttcaagaatccccaagtaggctcagcataatgggagccctccatggcaagaagtgagcaggttaagagaggcaagggccaggtcactaaggctcttatgtatcaaagagttggattttcttctaaagcagtggttctcaatgtggggtaattttgcccctcaggagacatttggcaatgtctggagacagtttgcattgtgacatcgtggagacaggttgctgctggcatctaatggtcaagaggttaaggtcagtaaacatcctccaacgcacaaggatatccccactccccacctcacccccaggactggctacgtaatttgtaaggtccagtgcaaagtgaaattatgggaccccttgttcaagaagcaggaaaaaggtgcctttaaaagcattaaaggccgggcatggtggcttacgcctgtaatcccagcactttgggaggccgaggcaggcggatcacctgaggtcaggagttcgagaccagcctggccaacatggtgaaaccctgtctctactaaaaatgcaaaaattagccaggcgtggtggcaggcgcctgtaatcccagctacttgggtggctgaggcaggagaattgcttgaacccgggaggcagagtttgcagtgaggcaagatggtaccacttcactccagcctgggtgacagagtgagactccatctcaaaaaaaaaaaaagtattaaaatataaggccaacgtagtggctcacatccataatcccagtgctttgggaggcaggaggatctcttgaagacagcctgggcgacatagcaagatcccgtctctacaaaaaatttaaaaattagccagcatggtaatttttacatgcctgtagtcccagctactcaggaagctgaggcagggggatcattcggggctgcagtgagctatgatcacaccactgcacttcagtctgagtaatggagcaagaccctgtctctaaaattttttaaaaagtattaaaacctaaagtttttttttccccttttttccatggtctctttttatttgtcatcacggtgttttttatttgctatttaatgctattctaaatacataaaaacttaaaaatttaaactataagcatgaattttaccatttacctttttatcactcaatgccagttttaaattgcaaacataagaatatttaatcatccgcagaatcatcaaaattaagctatttgtatgtcatagttcgtacatgcataggtattttgttcttaccagaacagtagaaatggtgcacaaaactcagccacctgtttttatttcacttcttcatattggcacattccaccaatcctctctaccttctgcttagtaatgagggaggaaaggctgaaaggaaaaggaacagagtttccctttccttctatgtagggttacctgatgaaatataggattcctagtttaatttggattttgggtaaacagtaaataaaaatgtattataaatatgtgccattatatattttgggacatatttatactaaaaaattatttgctgtttatctgagattcaaatttaacaggtatcttgtatttttatttgctaaattaaacccttcttctgtaacatcattttcagcataagtagttggcaagttcagggaagtaacattagtaagaaagagtatgttggagtttcttggccatttgcatttcttagtagccattgcctgctttctgcattcaaagcagggtgtggtcggaaagcatcttggggctatcagggaccctgtgtactcaactgcaaactcaacacacttattttgtacttgctctgattttcacagaacctccatgcatcatgggtccacccgaactctgtgcggtggggcactgggaacattatattgcaaatggggcagcaatggccatggcgtgcatactgctgtatctgctctgctcatgggcacactgcatcgtcccattggatttaacttacaaaacacaagtttatttattttttttgagacagagtgttgttctgtcgccaggctggagtgcagtggcatgatcttggctcactgtaacctccatctcccgggttcaggtgattctcctgcctcagcttcccaagtagctgggactacaggtgtgcaccaccacactcagctaatttttgtatttttagtagagactgggttttgccatgttggccaggctggtctctaactcctgacatcaggtgatccttccccatcagcctcccagagtgctgagattacaggtgtgagtcattgtgcctggccacaaaacacatgtttaaagttaagattattagaatgtcaagatgctgaagcagagcaggaaaccaggaagagggcccttctgagtacccggccctgtgggactgtgtgagctgcatgcccacgaatccagccctgtatgtggcccaaaatgtcaatactgctgaggtggagaaaccctgttctaaaggaaatagagagccattgaaggattttaaacagttagagaagactgagtttggtgacgggtggcaacaaaagattatgctttagaagaatcttttggacacacagtgtagcatttgggtccaagtaggggaggagtggacttgcatctttcttgcaggggagaggattaatatattttattttttaatttttaatttttttgagatagagcctcactctgttgcccaggttggagtgcagtggagcgatctcagcttactgcaacctctgcctcccaggttcaagtgtttctcctgtctcagcctcctgagtagctgggattacaggtgcccaccactatgcctggctaatttttgtatttttagtagagacagggcttcaccatgttggtcaggctggtcttgaacttctgacctcaagtgatccacctgccttggcctcccaaagtgctgggattacaggagtcagccactgtgcccagccattaatatattttaaaaagtgtggattgaaaaaattgcatgtagtcaaatacccttaaaatcccttaggaaggtgctgggtggtgaaagtcacacctgcttgccatgtgctacacccaaccaggtttcctccagcttgggtgcagattgttcatccttcagttgggatgatgtgtgaagttgggagcttatgtttagcatctgtgttgcatgaaaaatgtttaaacactggaattgcactcaaggtagggagacgctcatgccaccagcagcccacaggtactgagactgactgggaggagagcagacactggtctctgtaccatgctcactctagagtggccagtcattggctcaccatacatactggtgggtaggattagcagtgccatttaaattgctgctccagcatccatgatctccttgccccattttgtagcagccatgttgtgtggggaactgaccccaacccctgccctaggcatgggtcctgactagtctaagccaaccaggttagttctatcccctagccacagtgattggcttgaataacacaggcctaagtcaccagacaatggcggtcccatggccacagcaaagaagtggccaaccaacttgaagccaggacttctgttccatgatttggacctgcttgctttctccttcttggtgtaaacaaggagtaccagttgccactggaagccatattgtcatgatgaggaaagccatgtcagcaaaaaagccaacacatgaaggaagacagagctgaatgtaagaattaaagaaaggagagagaaacacgaaggtggcttgacagtcaacaggtttatttcagaaaacaaacctgggagggacttctgaccaagttgggttaggagccacacccacttacagactaagagtttttaaggattcagggtgggagagtttattagagtcttggactgcttctgtgtctctttgttgtgcttatctgggaggcagaattgcatgtctgttcccatacatctttctgcagctgcaggcatatcccccgagtcggcttttagcttccctatatcttagtgcacctgatgggaaaggaatgtacttattaaggcccactaagttttactggggcccattgtatgagggtgaagtttggcagttaccaagagactttcttcccacctccctctgtgcccaagctgtcttatctgtgttttactatctgctttttctggctgcttgtagctagaagagaaataatttctggctgggcgcggtggctcacccctctaatcccagcactttgggaggccgaggcaggcagatcatgaggtcaagagattgagaccatcctggccaacatggtgaaaccctgtctctactaaaaatacaaaaatcagctgggcatggtggcatgcacctgtagtcccaactactcgggaggctgaggcaagagaatcgcttgaactcaggaggcagaggttgcagtgagccaagatccagccactactggactccagcgtggtgacagagagaggctccgtcaaaaaaaaaaaaaaaaaaaaggccaggtgcggtggctcacacctgtaattccaacactttgggaagccgagacgggcggatcacgaggtcaggagatcgagaccatcctggctaacacggtgaaaccccgactctactaaaaatataaaaaattagctgggcgttgtgtcccagctacctgggaggctgaggcaggggaatggcgtgaacccaggaggcggagcttgcagtgagctgagatcacgccactgcactccagcctgggcgactgagccagactccatctgcaaaaaaaaaaaaaaaaaaaaaaaagaaaagaaaaaaagaagtaatttccttgaaatagatgaggctagaaagggagctggaatttaaagtggtggtgtttgtccaaggtgacggtgctcctgctctgtcagagagaattgccaataaatgaagccaaatcattgactgaattataccttaagcctcttcccattaagctcttaactttgcattacaatcctctttatggcttactccagtttgaagtaaactgaagttgagttttgtgatgttctcaagcacaggcatcctgcctttcaagcaggaccccactgcacacacaagatgaaaggtgtgccgtcttgttgaggaagagagaatgaactctcagagaagggggaaaggggttctgctgggtgttctcagttgactcatacccataacagctccctttgggggtgtattgtcactattgtatccatcttgtgggaggttttatgacttacccacagttacatgccacagtgaagttgaataaagatgactctatcaccctgtgcagatgacttccagaggtttgatggtccttgggtgccacagcgaagtaatattgatgaggcttaggatacatgaatgggaaggttgtgcataatgagccagtgcacactcaacatctagtgtgaactggaatagtcagaactcctctctcctccccggtcaacactcctcccctctcctggtttctgctttgctcttagccagttcccatgtggtaggcagaattcttaattggcttcccaagattttccaccttaatccctgggcctgtgactttaatgagattatccgcccatgattatgttgtgttactactggcaaaagagattttgaagatgtaattaaggctaataatcatttggcttagagttaatcaaaagggagattatccaagtgggcctaacttaattacatcctttttaaaagcagagttttctttggctggtggcagatgaggaggtcagagagattcaaagcatgagaaggatttggcatgtccttgctggctttgaagatagagggaccacactcaaggaccagagagaagccacagttgctgacagtgacccttcaccaacagccagcaaggaaatggacctcagccctgtggctgcatgaaactgaattctgccagcaacccccaaagaacttggaagtgtgttctttcccacagcacccagatgagagcccagccaagctgacaccctgatttcagcccctgagtagagaatccagtagagtctgcctgaacttctgacccatagaaatgtgagataataaaagggtgttgttttaaaccattaaatttctagtaattcatcacaaagcaatagaaaactaatacactccattaaggtgtcagctagtaattcctcaagtgctttttattaggagctctggaggtagacaaacttaaacatgcaaatgtatgaatctctattttaagcacctggttgaagaggaagatattttgggttaagaggtatgtctggcatcttattttcatttatttatttatttagagatggagtctcactctgtcacccaggctggggtgcagtggtatgatctcggctcactgcaacctccgcctcccatattcaagcgattctcctgcctcagcttattgaatagctgggattacaggcatgtgccaccacacccagctaatttttgtatttttagtagagatggggtttcaccatgttggtcaggctggtctcgaacccctgacctcatcatccgcccacctcggcctcccaaagtgctgggattacaggtgtgggccaccgcgcccggcctattttctttctttaaaagctgagaccgatgatgtgggagcaatcacacacctcctatgcatatataaaaaccagtaagatccttaaaaataggtttggtttccaatcattgttaaggttttcaggctgggtgcggtggctcacggctgtaatcccagcactttgggaggccgaggtgggtggattgcgaggtcaggagtttgagaccagcctggctagcatggtgaaaccctgtctctactaaaaatacaaaaattagctggacatgatggcgctcacctgttgtcccagctactcgggagtctgaggcaggagaatcgcttgaacccaggaggtagaggttgcagtgagccaagatcgcaccactgcactctggcctaggcaacaagagcgagactccatcccgaaaaaaaaaatgttaataaaagttataaattgggaaaggcacaattatagctttgtgaacaggcatatgtaaccctgataggcgaaggggctgtcttagtctgttttgtgttgctataacaaaataccactgactgggtaatttacaaacagtataaatttatttggttcactgttctggaggctgagaagtccaagatcgaggggccatatctggtgacagccttcttgctgccttataccatgatggatagaaggaagggcaagggagggcgggagagaaagcatgagggtcagactcccttttataacatcaacttttttttttttttggagacggagtcttgctctgtcacccaggttggagtgcagaggcgcgatcttggttcactgcaacctccgccacctgggttcaagcaattctcctgcctcagcctcccaagtagctgggattacaggcatgtgccgccacacctagctaactttctgtatttttagtggagacagggtttcaccatgttggccaggctggtccggaactcctcacctcaggtgatccacccgcttcagcctcccaaagtgttgggattataggtgtgagccactgctcccagccctcccttttataacatctggctccctcaagataactaacccacccccaagttaacgacactaatccattcacctcttattaagcctcaccttccaacattgttgcatattaagtttccaacacatgaactctaggggacacattcaaatcacaggggggtctgatatagtaacctgggaaaagataaaaacaaaaaatattccttgacctgtctaatgaccattttagaggtgaaatgctgcatttaggtactaaataatttaagtctaaaatacatattcaagtaatgcattttaatttttttttttttcttgagacagagtctcactccgtcacccaggctggagtgcagtggctcaatctcggctcactgcaacctctgcctcctgggttcaagtgattctcatgcctcagcctcccaagtagttggaatgacaggcgtgcgtcaccacacctggctgatttttgtgtttgtagtagagacggggttctgccatgttggtcaggctggtcttgaaatcctgacctcaagtgatctacccacctcagcctcccaaagtgctgggattacaggcatgagccactgcacctggccaagtaatccattttaaattggtacaaatgaaagcaaagaggcaaatgcatgtattagagttgcagggccagattctgcccatgagggtttgtaattctctttacctgagtctgcaggtggagtgcatgagtgttgccaagggaaacatctagccctttccttgtcaaacattgctctgaaagccaattcatatgtactcttaattgaacacccagtaatttcacagtatgtgcaaaatatcattaggctggggggttaggtggaaggatgaacaggcagagcacagaggatttttagagtggtgaggaaactgatacatgtaatggtagatacatgtcagtatacatttgtccaaacccacaggatggacaacaccaagaatgaaccctgatatcaactatggactctgggtaatgataatgtatcaatgtaggttcatcagttgtaacaaatggaccactctggggagggactttgataatgggggaggctagtcatgtgtgggggcagaggatatatgggatatctttgcacttcctcttaattgtgttgggaacctaaaactgctctgaaaaattaagtcttaaagatttggacaggaaaaaaaatacatcaggcctcaggaagctgaagaagatgccttttgacctaatgtgctgatcaggacccctttgcatcataaatataccaactcccaattattgcacctctgtctcatgtaaatttccttccaatgttaagaggaaatgcagcctgttcaaaagttttctttctttatgcgtgtcccataaatcaacaaacaggtaaaaagaaaaacccactgtttttctagacattaagaatgcagaaggcaggaaatatcaacaaagtctcttcattcattcattcattcaacagagagcaggactctgcacagcacaccacaggccgcctcattggttttggaggtcaagctggctcatggggcttcccaaagtctaggaccctggatcatcaatcctaatgtaaaagcctgcatctgtgagtccgtactcctgtcaattcctcttcctgttcagagcctccctgcatcttactttctgtgcactccgcaactacctcttctactgcctaattgttgacctcagatgtagaattttctttctcttttttttttttttttttgagatggagactccctctgttgcctaggctggagtgcagtggcacagtctcggctcactgcaacctccaccttccaggttcaagcgagtcttctgcctcagcctcccaagtagctgggactacaggcacgtgccactatgcccggctgatttttgtattttcagtagagacggggtttcaccatattggccaggctggtcttgaactcctgaccttgtgatccacctgccttggcctcccaaagtgctgggattacaggcgtgagccaccgtgcctggccaagatgcagaattttcaagtcaccaactgtttggagattctcaggccaaacctgtccattttcagaatgagtctttcatagaaagatacgaagcggcaatccagtgggaaaggattggtgggcacagattcagcctgtgtgccctgttagaatttgtcagactgtcgtgatcattcaaccagatagaaggggcctccctgaaggtgggaaattattttcctgacatcagacattcatcttagcatggatgacggctccttcctctccatcttaatgaatccatgtgaattaaaagaaatcaggcagatctaaagacgtcattcaactgtgtttcccttccttgctccctccctgcctcttctctctttcttccttccctccctctctgcctccctcatctcctttctcctccctcccttcttcttcccctctagggctcaagcgtgcaccatggtcaacaggtctctcccttactaccctgagctgtagagaaagaggctgggaccacaaagaggtggcagagggaagagaatccacagaaacctctaacagtcctcatttttcctggccagtctgaggttgggttatgtggctatagaggagaacagaatgagaacctgtccctgctttactcagtgatttcttcatcgtgttctggaccatttggaagctccatgagtggagtgaaggagagaggctgagcaccatccccgctgccctcagctgtgtgaccatgaagaagttgcatgtttccagtttcaccatgtgtaagccaaccttacaccagatagggagccctagcttcctgccccacttgttgcaagggctcagtcaatggcaggcctgtgtgcaatgggttattacatgaaatgccagtgcggaagggattgtaggggtcattgagcccaactgcttgaccttcctgatgtggagaccacagcccagagaagttaatgcacttttcaaggtcacaggtgttatttagtggcaccatcccctgggcctcagagtcctcggctggaattgtcagcgcttcctaaacccttcttggagtgaatactccagaaccattgaaatatgcatttgcgtcttccatattttctttgatatgtgtactggccattgctgaatacagggtttgaagctatcttttttacaccgaaacaaaacagaataaaacaaaacaacccattcaagatgatttacaaattgaaggcacctaataataatacctcgcatttttggagagctttttatttgcagaacacttcccagacagtaactaatgaattctccaactccccttaggaatagtgacatatgcattcccacgcacactaggaacttaatttacatgaaacgaagaaaaagtcattataaagtggcattcccctaaatcataattacaaccttcagcccaagataaacatgctgaaccctcccagggatgctgcgatgttcacccactgcgggggtctccacttcgatcccagcgctgcctgcataaggaggacagaccaggagtattcacacaaagtcagttctctctgggatcaaggtcccattttccagccaaacaactggaggttaatggcttgttagggggcaagtgctggggcagtggtctccttctgtcaattaaaaagaagacagagtgatgggatgtcatggaggtgccagggactcgtgtgtgaaccgggaatgtgggtttttacaaagaggagtctggaggtggacctccaggagtttttggtccctgagggaggggcagcagtcttcccggcacttcatgaaccacatactggctgttgctgccttcgcctccccagggggctggtcccatgctctggcggccaggctcaggcatccacctgtccactcagtgccctggccccctgccgtgggtcttgccttatttagcacaaataaccctcagtgcattgtgatgacatcagccaccaatgtcgatgtctccatgtaccacatttgacatgtcccaggctaaatagctgctttttttttttttttttgagatggagtttcactctgttgcccaagctggagtgctgtggtgtgatctcggctcacggcaagctatgcctcctgggttgaagcgattctcctgcctcagcctcccgagtagctgggattacaggcacccgccaccatgcctggctaatttttgtatttttagtagagacgggggtttcaccatgttggccaggctggtctggaactcctggcctcaggtgatccgcccacctcagcctcgcaaactgctgggcttccaggcgtgagccaccgcgcccggccaatggctgctttcttaacggcacaatgactaaatgtggaactgctcctctctggtcagcaggcacattgagaatgggtcccagggggaggactgcacccttttacctgctcctcatccctcagccttttcctgcccatggctgatgccaagcgccccaggctctggactctgggctgtcctgagtcagaagccacatctcagcccaggtggctcagtccaccctccttgtgctgctccagctcatgtgtccccgcattaataagtggcttctggccgggtgcggtggctcacgcctgtaatcccagcactttgggaggcccaggggggcggatcacgaggtcaggagatcgagactatcctggctaacacggtgaaaccccgtctctacaaaaaatacaaaaaattagccgggcgtggtggcgcgcgcctgtagtcccagctacttgggaggcggaggcaggaaaatggcgtgaacccagaaggcggagcttgcagtgagctgagattgcaccactgcaatccagcctgggtgacaaagcgagactctgtctcaaaaagtaaaaataataataattaaaaaaattaaaaaataagtggcttctggccaggcatggtgggcggattgcctgaggtcaggagttccagaccagcctggccaacatggtgaaaccctgtctctactaaaaacacaaaaattagccaggcgtggtggcacaagcatgtaatcccagctacatgggaggctgaggcaggagaatcacttgaaccagggaggcagatgttgctgtgagctgaggttgagctactgcactccagcctgggtgacagatcgggactccacctcaaaaaaaaaaaaaaaaaaaaaaaaaaggtggcttctgcccttgttcctggactaggttcctggttcatacccagcataggatgtactgtgttgacccgcagtgggtcggaaccatctggccttacttctgagtgcacctgtttcaaggccagggtagaaatggtctcaacgtgatctctgatagagaaaatatttctgcctcaaggggatatttttaaaggctaaattaggagtgcctgccaaaaatctacctcacactagactcacagctgtggctgagacaacaaaggccaaaaacaggttgcagggaggagagacctccccagggtcccactggatgtactgagcagagatgtggcaaagcagccagcgggaatgaacagcaaagtgaaccaggaaggccagagtagccagagctggagccaagtagggtggcagccagcagggttgcagcctcagtgaggtgcccagatggccaaggcactctcagaaagcaagttagacggggccgggtgcagtggctcatgcctgtaatcccagcactttgggaggctgaggtgggcacatcacttgaggtcaggagttcgacaccagcctgaccaatatggtgaaaccccgtctctactaaaaatacaaaaattagctgggcgtggtggtacacgcctgtggtcccagctacttgagaggttgagacaggagaatcacttaaacccgggggcagaggttgcagtgagccaaaaaaaaaaaaaaaaaaaaaaaaagaaagaaagttagaagaaggaggaacccacccaccagcatgcagaacaccccgtgggaagtctgagctgcgtcagatctgaggcttacatggaaattctcctgccactggcaaacatttgatttattttattttattttattttttgagacagagtcttgctctgtctcccaggctggagtgcagtggtgtgatatcagctcagtgcaacctccgcctcttgggtttgagcagttctcctgcctcagcctcccatgtagctgggattacaggcacgtgacatgatgcctagctaatttcttttgtatttttagtagagatggggtctcaccatgtttgccaggctggtctcgaactggcaggagacttcaggtgacctgcccacctcggcctcccaaagtgctgggattacagccaggagccaccatgcttggctgatgtttttaaagcagagagaggatcaagacagccatagagaaataataataataataataataataataataataataataataatgataaaatccatgatttcattaaaaatcaagaaagggtgccttaaaaggtccaggagctttgaggcacctctgagagatggaagaagtgtgggatcattgtgaagaaggaaatcacagtccagaggctatgcagaatgaaaaatataagggccagctacagtggctcatgcctgtaatcccagcacttagggaggctgaggtgggaggatcacttgaggccaggaatttgagaccagcctaggcaacatagggagacactgtctctacaaataaaaaattaaaaaattagctggccacagtggaggcacacctgtagtcccagctattcaggaggctcagaagttcaaggctatggtgagctctgatcacaccactgcattccagcctgagcaaaaagaatgagaccctgtttcttaaaaaataaataaataaaaaacaaaaaaaggcacaaaaagaaaaaaaaccctaaaggatgggctgcttatgctcatggaggatccctagaggagcagcaacttctccatcctcaggccaagaagcaggcagcaagatgtgagcccctagtatagagcagagggttcagatggttgggatggagaggtcgctggcgccccggcaatgcccaggagggatggcatgctctttctgtccaggaggtgaaatgcaggctatagaaagagcattggtggagaggctgcaaaccgaatcccagagttgagctcacaccaataacccctcaacatttgagaaaagccataagagaggtatcaatcctaacaaatcgaaaagtttacatccaaagaagcagttttaatagaggaatccacacaaggatttggcatatatataattagaatcctcagagagaagtaaaatgatattgcatccataaaaaggaatgttttagagatcttggaaatgacaaatttgatgattgaaataaaaatctctgtaaatgggcagaagcattggagattatagaataaattgaaagcctgagccacaggatgctcttagaatagcaaaaatggacaaggagatgggaagtacagaaaatggttaagagaattcgaagatagaccctatagttcccaacgtgcacctaacagagcttcagaagacaagacagagggaccggaagagagagtgtgctcagagcaatcatggagggtgggctcccagggcaagggcaggtgacagccccagagtgaaagtgcccgggaatggctgagcagaatcatgggcaagctacagcatggtgacatttcagacaacagggataaagagaaaaccccaaatgcttctgcggtcaggggagtggggagaggtgagactgtattactacaaagatgtactgaatgcaagaagaaactggagcaatctcttccaacttctgaggaaaatactcctgaattagagttccacagcaaggccaggtgcggtggctcacgtctgtaatcctagcactttggaaggctgaggcaggtggatcacctgaggtcaggagttcaagaccagcctggccagtcacggtggctcacgcctgcaatcccagcactttgggaggccaaggtgggtggatcacttgaggtcaagagtttgagaccagcctgaccaacatggtgaaaccctatctctactaaaaatacaaaaattagctgggcgtggtggcgcatgcctgtagtctcagctactcgggaggctgagatggtagaatcacttgaacccaggaggcagaggttgcagtgagccaagatcgcgccactacactccagcctgggcacacaaaacaagactctgtctccaaaaaaaaaaaaaaaaaaaaaaaaaagccaggtgcagtggctcatgcctgtaatcccagcactttgggtggctgaggtgggtggatcacctgaggtcgggagttcgaggccagcctgaccaacatggagaaaccccgtctctactaaaaatacaaaattagcaaaattagctaggcatcatggtgaatgcctgtaatcccagctactcgggagcctgaggcaggagaatcacttgaacccaggaggccgaggttgcagtgagctgcgattgtgccattacactccagcctgggcaagaagagcgaaatgctgactcaaaaaaaaaaatgtatagggttcagtaatttttagtatattcacaagtttatgcaaccatcccactactcaattccagaatattttcatcaccctaaaaagaaaccttgtctccatcagcagtcactccccattctccttccccgacctctggcaaccaccaatccacttcctgactctctgaatttgtccattctggacatttcatatgaatggaatcttacaacatgtggccttttttgtctggcttcttgtacttagcacaatgttttcaaggttcttgcatgttgtagcatgtatcaatattccttttttgttctactatatgggcatacccactttgtttattgatttatcagttgatgggctgttttcttttttttgactattatgaatgacactgctatgaaaattcatgtacacatttttatgcgaatatatactttcagttctcttgagtatatacctaggagtggaattgctgggtcatatggtaacctgggtttcactgttggaggagctgctaagctgttttccacagtggctgcaccagtttctgttcccaccagctggccctgtcctctgcctgaagggtggtcactttgctgggcactgcaaagagagacaaaccccacggtgtcattaggcctcacttgaagccacgcaggtcttaattctagtttaatgggaggttcacacaggactctgttttctgaggagtccccaagacagtaggtgtcaaccactctcgtgtcccacagtgaggtgaggcctaccacgcagggagtgcagatagcagagaactgcgcttcagaacctgagttgagatgacttgcttcaggcctggagaggacgctggagaggccacaggaagggctaggactacggacaggaagaggtgctgtgttctgagtctcagccctgctctctgtgttccagcacatctaatgagaagtgctgaggagaaagtttggcctgtgcttctgcagcttgcgtagtgggataatttctcacactcacaggtgtggaagtcaaagctgcctgtggcagcagagaagggatgtgtttgggaggtaaccagtgcccccctgtcctgcttgggtcaaatacatgtccttctgtgtatcaggtggggccacatgcaagagagctggtctaggcttgatttagagcctagcctccagtcctgcccaagatgtgtcctggagagatgtggaggcctcagcagagaagctggggggtcccataggatgcccagatgctgaggaggggctggatatttgtttgctcaggctgccctaacaaaattccacagacctggggcttaaacaacagaaatagactgtctcacagttctggaggctggaagtccaagatcaagttgctggcagagttggccccctctgaaggctgtgagggagggatctgttccaggcctggctccttggtgctgtgcacccctggtggctgtctgtgtgtccatatctccttataaggacaccaggtagagtggattagggctcaccctaacagcctcattttaacttaattacgtctttaaaggccctatctctaaatgcagtcacattctgaggcactgggggccaggacttctgcctgtgaattgtggggacatgctcagcctatacaagttggcatacttctgtctgtctggggaaccacaggtgagagatccctgtgatgggagtggaggaggcaggaggaagagagttttcttccagagtcacgttaaggacaccccaagacagagtcagcaccaggctaggaccccaatcccaggcacatccaagccagtgaaggaaaaatctccctccctacactttgggctagagttggaagtcactgaaggaatgctgggcagggaagcagtgaagaggtggccacagccctttgcctctgatgacctgccaccaaaggcaccaggcagtgcctttgggtgggacagagtgtacaaagcaacaaatccatgcagggtgcagcagggccggagctaggggtgaaggaccagggacaggggggcagggggaagctgctggagtttgcagtcataaaaattgctggaacagctttgtgcttctatttgcccccaggtcaccatggtttggggagacatattacatgtataaaacactgcagcttggtgggcagggggcagctggacaccagcccaataaccctcatatgggccttgtctcttggagaacagagactgagaatggtcaggaatttggttggcagtaaaaggctcatgaagtcattcggtacttttcatacagtcctgtaagccatgctactaaggcatgtagtattttttttttttttaaactggaacagatagtcccctgtttggaacaagttcatttataggaaatatgatatgcaatggatagttaatttaaaaagaaacatttagcccaaaataatcttgcaaaagaagaacaaagttggaagactcacattcctgatttcagatattactacaaagttacagtaatcaagatggtgtggtgctgccataaggatggatatagaggttattggaatgggaatgagagtccagaaataagccctcgtgtgtgcagccaattcattttggacaagggtgccaagaaaattcaatggggggtggggagagaatactctttttaataaatggtgctgagatagctggatatccacatgcaaaagaatgaagctgcacccctacctcacaccatacacaaaaagtaacttaaaatgaatcacagatctaaatactacagctaaaactttgaaagtccttgaagaggatataagagcaaatcttcatgaccttgagttgaacaaagccttcttatatatgacatgaaagcctgagacaaaatttcaaatggatacattaaacttcatcacaatgagaaacttttgcacaaccaaaggcagtatcaagaaggtgaagagaaaactcacagaatttgagaaaatatttgcaaatcatatatctgatagggatctagcattcagaacatataaaaaccccttacaacttaacaataaaaagacaaataacctaattttaaaatgggcaaaggatttgcataaacatttctccaaggaagatataaaatggccaataactatataaaaggatgctcaacatccttagtattagggaaatgcaaagcagaactgctatgcaatattacgtcacacttactaggatagttagaataagaaaagatggaccataacaagtgttgacaaggacatgaagaaatggaaaatcccgttcctcgttggtggaaatatacaatggtgctgctcctgtggaaaatgcattggcagtttcccaaaaggctaaacatacaggtagcacgacccagccattccacacctaggtatatactgaaaagaattcaaaacatatcttcacacaaatacttgtgctatgaatgttcatactggcattattcatagtagccaaaaggtggaaataacccaatgcccatcaactgatgaatagataaaaacaatgtgtttctctccatgcaaggagatattcagctgtaaataaaaatgaagtgctgataacatgctacaatatggatgaaccttggaaacactgtgctaagtgaaagaagtcagacacaaaaggagacatattgtataattccacctatatgaaatgtccagaatgggcaaatccacagagatggaaactagattcgtggttgccagggattgtggggaggggagattggggaatgactgctaatgggtccagggtttctatctggggtgataaaaatgttgtggaggctgggtgcggtggctcacacctgtaatcccagtactttgggtggccaaggtggttggatcatctgagttcaggggttcaagaccagcctggccgacatggtgaaatcccatctctactaaaaatacaaaaattagccaggagtgatcgtgggtgcctgtaatcccagctactcgggaggctaagacaggagaattgcttgaaccctgggaggcggaggttgcagtgagccaagaccacaccactgcactccagactgggcaacaaaagcgaaactccatctcaaaaaaaaaaaaaaaaaaaaagttctggaattagacagtggtgatggttgcataatcttgtgaatacactaaaaaccactggactttacactgtaaaagatacattttatgctttgtgaattatatatcaatttttaaaaacgtaatgagtcaacttaaatatccatcaatagggaatgttaaataaaccaagatgaattgtactacagagatactgagcagaggtcccaagcaatgaggtagatctttctgtactgatactgaacaatgtcccagatttcctactaaatgataaaagcaagtttcagaacacaaaacagcatgtataatgtgaatctatttgtgttaaatacacacacatacacacacacacacagacatgtaaatgaatatggacagatatatctaattgacaagagtgggtgctgtggctcacacctgcaatcccagcactttgggaagctgaggcggaggatcacttgcggccaggagctcaagactagtgtggctctctttggggtgaactgtatggggataaaggggaactcttatctatttatattgtatacttttttttaagcagcattgtattacttgatttaaaataaatttcaaagaagaaaaggggaaagaaatgtagtgaactaaaaacggcttatgttggggtttagcattgaatattttaaatatttgtctgctggttatttgaattatgtcacaaagtaacagcttacatttgcacactgctttacagtaaataaagcttagacatattaaaaaaaaacataaaagcaaaaaaccccctttagcaagaatattccaggctctattacaggttatttctttttcactctaacgtgacacttacttaacatttccttccaagagtattctcagattggtgtgcctttactttttcttttttgaaacagggtcttactctgttgcccaggctggagtgcagtggtgtgataatagctcactgcagccttgaactcctgggctcaagtgatcctcctacctcagcctccctagtagagtagctgggaccacagggacgtgccaccatgtctggctaattcttgtatttcttttcttttcttttttttttttttttgagacagagtcttgctctgtcaccaggctggagtgcaatggcacgatctcagctcactgcaacctctgcctcccaggttcaagcgattctcctgcctcagcctcccaagtagctggacctacaggcatgcgccaccacacccggctaattttttgtattttagtagagatggggttttaccatgttggccaagatggtctccatctcctcaactcgtgatctgcctgcctcggcctcccaaagtgttgggattacaggcgtgagccaccgcgcccggccaatttttgtatttcttgtagagtcggggtttcaccatattccccatgctaatcttgaactcctaggctcaagcaagctgcctgcctcagcctcccaaagggctgggttaactggcctgagccactgcccctggctgctgctcctttctttacaatgatgttgcccattttagtaggtcgggtggattcatacttttgtaggggaaaaggtagtttttttatgattagttgattatatttaagacaaaacgtaacacatgtgaaaggacaacattttacttggaaagaagtttaaggaagagacactaggatgttttagagacagagtgatgttgatttcaaggtttattgagacattaaaaaagtaatttcactgataaattaatatttccctttaaatataaaagtgcttatgcttacgaatccttaaggctcgttctgttacggtacagtaagatgtttccccatcccaggaactgcactgcgtgagtttcaggtgaatttatagaaacagcaaaatctccaaacagtaaagtaagtggtcaaagactccatcatctttgcacttgtaaattttagactcagataaaatacaagatccttctagacaaattcttaatattagatgtgttctccactccttcctaagattgtgccaaaataattcactattaaattattcatgatttgaatgtggagttttctttgcaatatgataaatgcaactgtggtgacacgagagagagagagagagagaaagggggtttaacgtttgcactgcctcatgcagatatgggtaacccccaaagtgaagattttaggttccgggtgtgcagatatcttaaaagcagactgggagatgggattcctaaacaggaataagagatttggcctgcttagggggagggatccacttaaacttcctaggaagacttaaaaggtcactgtttcagctgatatactttgcaccctcaccgcagattgcaaattatttttgcacagtactacactagaactatgcgcaatgtcctcatagttatgtgtagatgtgcttttatgaagaaaacaacatttattgtaggtttttagaatttctttttctctttttttttgagacggagtctcgctctgttgcccaggctgaagtgcagtggcgtgatctcggctcactgcaacctccgccttccgggttcaagcaattctgtctcagcctggtttttagaatttctaacttcagaagaatcacaagctcattgcagaaaatttggaaaacagagacaagcacaaaagaaaacaccagtcttccaaacagtgaaatattttgatgcatgtactttccagtctatttatatgaatgccttaaaataaatttttatcatatataatgttttggagtagaaaaaaacaataaagtttccctgcaagaagtattcacagattttgagaagaaaggctggaagaagtgattcttactaaagccaatggtctttaatgaattgcttggattaactttttttttttcccacatactcagagacacagataggagcctgcaactttctcagccgtagtgtttgtaatgttgctgcttaacagagccattacagctacttggattaaaatagtgactatcaacacagattctggactttctccacaatcacatccaaatgcactaacaagaagccccaaatgaatatcacataacaaaatgaacttgatctactttaatagagaataactagaagagatatgaaaatggtattggacctaataaacggcattttcatcaatgctacaatgtgtacattttcacgacataaattactatacagaattgtcctacttaaaatcctcttcaattcttgaaaccatcctaagattgatggctgtaagaagatgaagatcttataatttgtttttgtgactgccaaagctggatacctggaaaattctcgagggagataagctggctcccaagttgctgacagctttcccaagaccaaaacgcagaatttgaaacggtgtttgatgtgacacactaggcctttgatatcagaatactgaagcagagttgctagctccatgaataaacctccaagatgacacacacagcataaaaaaatggtggaattttaaattccttcactgactggggcagaattcatgcgagggactttagatgtttacagaattgtgtaagcaagagactattacactgtaacaggagtatctgttccttagcaccctgcctgagaaagggtgaagtccaagtgtccacctggtgtatttcctcctgctaataaatattgtgttgccaggctgggtgctgtggctcacacctgtaatcccagcactttgggaggcagaggcgggcagatcacctgaggtcaggagttcgagaccagcctggccaacatggtgaaaccccatctctactaaaaatacaaaaattagccggatgtggtggcaggcgcctgtaatcccagctacttgggaggctgaggcaggagaattgcttgaacccgggagggggaggttgcagtgagctgagattgtgcaactgcaccctagcctgagtgacagaatgaggttctcaaaaaaaaaaatttttttttttgttgccactctagaagtttttagccaactacttggaatttgcttgcactgggcaaggtctcgtgcacctgtgaaaacaacattagtattaagttaggcataaatcaggctgaacctttcatcatctccagccatggttccttttattttttttattttttatttttttaactggagaaaggttaggaaagggatttccagtgaatatgaaaagaagggactcttcagtatgtcatgattactttggttaagctcaaagcactgatttactgatgcaaggcagacacactggccctgtgcctaaaaaatgtaacagctaaaaatttcaatccaccatttagggctttgaccctagtggtatgcaacatccagatcattagttggatttctagtctttgtctgcatgtttggggctagaatgtccagtcattgggcatcacaaagatcaatgagatcatatgttgattttcctctctactggtacagccactaaagtttttcctacaattaaatagttatgttgatgcaaccacctaacctcctagaggaaaaaaaaaacatccattttctcaagagaggtttcctctttctttcccgaagctcatgcatgacatacctaagtcccttatgacagatctcctttctcagagacgaacctccctgagcagctgtcctccacctcctacccccaccccctaacaaaaattaccatcagaggcacaagatccacatgaagagaactcaccatgggggcacaggaagcctgactgtgccacaggtctctggtgacgcttgtagcatgatgtgcagtgcacacgctgttttctcatggaagatggcagccattggaagcttggactccatgttgcttcttccccttcccatctggatagcccctgcttttttttcctttttttttttttgggatggagttttgctcttgttgcccaggttggagtgcagtggcacaatttcagctcactgcaacctctgcctcctgagttcaagagattcttccacctcagcctcccaagtagctgggattacaggtgcccaccaccacgcttggctaattttttgcatttttagtagagacagggtttcatcatgttggccaggctggtctcagactcctgacctcaggtgatccgcctgtctcggcattccaaagtgcagggattacaggcatgagccacagtgcccggcccctctgatttcttaaaactagggtgtgatgatgaggaggaggatggggcgtaccacccacagtggggtattaggtagccctgctgccctgcccgccttggtctgttagaactctgcctgcagccaggaaggactcaaagtggtagccacacaggtgaaggagctccctcactggtgtcttccctggctggtcctgtctctctcccatctcatgggggtgggtatggctaccctgctgtcatcctcttggtctgctagatcctagtccaatctagaccctaggagaaaattccatctcccacattgtacatgtctgcaccttggtgcctgcagacataatatacttcctttgcctctgttcctacagtaatgtttaaaaccctgtcaagtgtgacacctgggtatctcaaaaagcttgcccagatctgtcgctcagtaaggtgattgacatgttaagttacacctcacatagagaaaactgaggcacagagaagagctttattcaaagacccggtgcagcaggacaacggaagagggtgcttgggcactccagttactgttccaactgcgtggccccaacatgagtgcattcttacactggagctccatttccttaaagcctccactgttgctaacaactgttctattaatagtaaggagtcaagaaatgaaatccgacttatagaacttacaaggaaaaactctaaaggaacaaaagatcaacccagcccacagaggaggacgtgtgtgtgtgtgtgtgtgtgaagccctgggaacttcaagggattaataatcagtttgcaaattactcaaaagtgtcaatgctgctatgtcaccatttaaagaggcctcagagatggctggtgatgctatggaagtgtctgtaagtaaagatccatgtgacacatgcttagaattacagacatctcagctacatggccatcctttgggctttgtgatcactcatgctacagatgaaggtaagatgggagactccaagaatgttctttgaaaagtcagatacccttggctcctgtggatggaatgctgcttagtgaagtagtgcacattcctcactgctgagtattttctttttgctcctatgggcatctagaaataaagggatcttgaatactggggaaaattcagttttgttttatggaaaattgaaaaagcaacgataaggaaactagaacattgatattattttaattacccaacagcactctaaaaatcctaaacattggtgctatgttatatcatgtctagatccaagtatttctggatgagctttcctattttaaaaatgggtaaaaaaaacaaaacaaaacaaaacccaagtccctgattcagcttttcaggctacatcaatacccctggtgcttcaacacaaatgctgacccttgtactgactggcaattagtgccctgaattcaaccctcagatcaatgtctataaaattggctgtaagaggtggattttcaaagtaacacacagagatttaatcccttgattcccattactgtgagtaagagctgtgaacctaaatccccttgcagccaacacaaaatttaccccctgctgcctcggagtgccaattaaaataataaaaaccaaaaccgtgggcagatgtaattagtttgagaacggagtttataattttcctcatgccaagcaaacaagttaacccctttggtgacatatacagaataatctggacaaagggaacacaaatctcaagtctgaacatttcttgtgctatttgccaggaagttgtaatattgaaaaactgtgctcttctgagaatgggaaaatgaggacataaactctggttccaaatggttggaagtgcagtttatgtggtcaggttgtttttcccctttcattaaaaaaactttcaagattccacttgatccgggtttcttcgaaaatgtattactttttacaaatataattcttatagggacagacttcagctgtgtagcaggcaaagctacagaagagaacgttcttgaaagactgctgggtgtttcttagcacaaaccacctctgaaagagtatcaagctcagtggttggtgaagcaaagccaagttcctgtcccacccatctctgggatgaggagttctccatggtgaccctgagtcaggcttcttctgcacccctctgcctggttaatgaggactcaactgaactgcccatctgcaaacaaaccctttctgcatttttctctctagacacgagtgagttatgtcagatggtataatgggaaaaagacaaaggatatttgaatctaaggacatgggctggatcaggtgaagggatggttttgcttttgttgctgtttctgcttctttagtttggggaggaggataaggaaaagggttggagataagactaaaaatgaagttaacaaacttaccctcccacataggggatgcttcatgtcaagccactggtctaatgcctccgtcttctttagttcaaaattatcttattttactcaaccaaatattgcaaacatgattccaccatgttggtttcagttgtgtgcagttccctgactgcacacaagtcagggaactaacttgtgacactaaagaatgacaagcaaagcggcatcccagggctactggttgaacaggaaccctgtggccattgagatgaccttctcaagcttcctgttgagccttcactgggacactgggagcgtgcatgtgcatacgtgcatgcatgtgcgcgcgtgtgtgcgtatgtgtatgtatcaggaaatagcaaagacaaatagtaaactatagttataatgaagaaaaacatacttcttttccatgaaaaatgtcagacttcatactgataatctgtgggagctacatttaagccatttatgaaacaaaaagattgcttttcgagattataaactgggagccagaacaactgacttgaacgtattttgattctcaagtttccgtgtaaaaatattcacagaaattggtggatgtcttttacgtacaactcaacttctctcatttacaacataaatcatttaatgtaacatttgcaaccttagaaaggcagacatgtttaatccaagtccgtttataaattccaatttcacatggattaaaaactgcagataaattaagtcacaataatatcctgtacatgcattaaggctggtgactgctaaagtctcttgggaatctacaaataggaaatcacacgcagattactgggtctgaagagtgtctacattgttaaaaaaatcttgcttttttttttttttggtgatgcagatttcaacagtaactctggaaaactgtgaaaaatgttatttaaaaatatatatgtatatgctactgcacagtttcaaagatgtgattcataaataatgttggctgcactgattaattttataacaattactgcacttccaagttgatgcgaacacgcagtgactcatactcaatattaggcactagtaatatccttcaggcgtactacagttttatgttagctgtattgtacatatatatttttaaatgtatgcatttatacaaactgtgtatattatgtatggggtgtcagaaatgtacacatcactgttatataatacacacatcattgttgtacatatgaggataagttttagtgcagaaagtctcattgcattgcattccatgtgttcaatctagtacacaatttgtcaactcttcagattatttttccagtacattcctcattagattgtgggtttcaagtttccatttgcaatttgaatgtttccagaaatctctgtcttaaccaaacctctctctccaggcacgattctgcacatgagtctgatctgtgtagagtagtatcatcaaaaatgccaaattttgatcaggaatatacctggactactctctttcaaaggcaattgaacatcgtgataaaggatagcatctattcaggtcatggaaggatatggtcagttgaacttgtgttgaactttggaggcaaatgtacgtcttcaaataaaaagacatggtaataaaaattatttgcttaaatttgagagtctctggaaggatatacatcaaactgtgagcagtggttgtctcaggcagaagggacaaccagggacttacactttctactttctacatttctgcactgtttgagtttttacaatgagtagatattacttttctaattagaaaacacaagaaaggtatttcaacttgaaacaaaactaaacaggccaggcatggtggctcatgcactttgggaggccgaggccaaaggatcgcttgagcccaggagtttgagaccagcctgggcaacatagtgagacccccatctctacaaaaaaaataaagaaaaaattagccgggtgtggtggcacgtgcctatcttcccagctgcttgggaggctgaggcaggaggattgcttgagcccaggagtttgaggctgcagggagccatgatcgcgccaccgcattccagcttgggctacagagccagacccggtctcaaaaccaaccaaaccaacaacaacagcagtaacaacaaaactaagtaaaaggaacaagttatgaatgactttcacaagcaacaattggaggatggttactaaccaaaatcacccatgccaaaccccacagaaactgctgtaccaacgtgctccacacgtgctccacagatgaaacaagacagtcataagaactacacgctctgaccactgcccacaacggtaagtttcaagaagttttcctgggaaatgtgggccatcagagtgctgataaaacactgctggcccacctgtcaaatggggcttcacagggaagctcatcacatagatgttacaacaaagtctgcaactttcaaggtgggcaggaccagagaagctctccaggtatgcaggatagacctccagggccatccctttatgtgtttgaatatttcatcaggattcttcaagagtaggtagaacaaagcctcagtcctccaaaaaaatgactcaaaatttcttaagttaggttcaagtttctgacataggatgggattgtgaactctgccaaaaattagtgaaagggctgggtgtggtggctcacgcctgtaatcacaacactttgggaggtggaggcgggtagatcacctgaggtcaggagtttgagacgagcctggccaacatggtgaaacccagtctctactaaaaacacaaaaattagctgggcatggtagtgcacacctgtaatcccagctacttgggaggctgaggcgggacaatcacttgaacccaggaggcagaggatgcagtgagccgagatcgtgccactgcactccagcctgggcaacagagcgaaactcgtctcaaaaaaaaagtgaaagggttgtaagaagcaccccagttggagacatgtaaaatggaaattctcttaatatttccaaatgcttgaaggccaaagccaaatgcaaattccacaagcccttcttattttcaattaatttcaaatcatctaagttgttcagtcatttatacaattttgaatcagtgctcagagctaaggaattatgatgatcttacttcccacctacagatcaggctaacaaaaatgttaacactgcaaaccaacctgtaagaatatcagtgaatgtttatggatcagcatctagtctaagtattttgtgccgtcatcaccttgaaaaaatggattgcaccacatattacaccgcctgcctttctcagaccgtcctggtgcaactttatcaagtaagaggccacaaggacattatttttgtttttaacgtgtggcaagatagaccctctttttcaggagttattttcttttcgtcaagatttcatatccaaatatatttaacaagatgactaaatctagggcataagacactacaaaagaaaaaacatcagacaaaaactgtaaacaagatgtcaaagaaactaaaatgtaaacttaattaaaaaaagaaaacaagagaaaaactcagagcaaggtgtaaacataccagacacacaggacacaggaagaggctctggttgctgctgccccagaaaggaactgtgatcttctgcattgcaagcagcctgctaatcaaagcctgaaaaatcgcccccaaatcaaaacgcatcaaagggctgcaggtgcacattctgcatgaggagtgagagaatcagcattatcatggcaaatagctctcagcctggtaagcgaaggattcaggctcctactgaagggacaatctaggtaatggcctcatttagccaagaaaatctgtaagaaagctattggtggaaagaaaagacttgaaacagattggctgacaaatgccatgtggctctacagccaccgagtcacagtggcaggaagaagaaatgcatgtggctggtgggcttgttatcacaggtgcagaaaacttcaactcctaactgagctccaacacacaggcactgctaccttagtgtctgttaactttcaaagacgccgcgtttttgctaaatctcagtgccatttgcatactacttggaggtggggctgggaagggctgtgagtgtccatctgtttgcctggaatgcatttagttgataatagagtcagatgggggaagggaattagaggaagagcagggtatttggtaacatgcaatctagtaaacttccggcacaaaaatacctggcttattttcattattcaattacccattaatacataccaatcaaaaaataattggggaatagtatattaatactgaaagtaatcaacagtataagagcaggtccatcttcactggcagtcaagcttttggtgtgctgtattgcacctggttaactaacccatgagattttggttgaattttctaagaagtcacggtttagcactggaatggaatagaaagtgtgtgtctgtgattgtgtgtgagtgtacggtgtgtgtgtgtgtgtgtgtgtgtgtgtgtacttcctctagtcagaaacctctgatcactttgtctagcctgggattatggaaactagacaaagaaggtgtgttctgaagagctgtgtatcttacacacatacacaggcggcttcttatatacccacacatacaaacacacatgccctgcaaaagatcattgttcaatgctgaggaaatgttcaccgcagtctgataaatgctgtggctgggagtttcagtagcacagtgtccaaaaacgttgagccatctgtggagaccagagcccactctggccccagggtgaggtccctatgacaggtgggcgctgttccgcagccagtgcaggccctgttgggagtactggaccaggtgctccatgctgctgtgcagggtgaccggccccatgagcagatccaggtcgttgaagaattctagggggacagaaagagttgttaagaatgccacacatgctaggtgtgctatcctgagcaactgatgtaaggaaaaattccattcatggtctctatataaatcaaggattctccgttccatcatgtaactttagcattcctttgaacaaaataaaatccaaggatggggaactcatcctatatccaaataaataaatacatgatatctgccatttctaactcaaatgaatagtatttgcttagccaaatagcaaagaaaatccatatcctccagctgcattctcctagtccagtaatgcttcccactcctgaacgtgaacgtggctctgtcgtccctcaccctgtactcaattctggtatgcgctgagcccctggagtgagtccaaggggtgaggctccaggttcctgggggcaaatcagagatgggtcacgagacatctggactgaagtcaccttctagcttttgaacattccctaggtttgccctttcaccaaatgtttatgatgtggccaagcacggtggctcacacctggaattccggcactttaggaggctgaggcgggtagaacgcttgaggtcaggagatcgcgaccagtcaggacaacatggcaaaaccctgtctctactaaagatacaaacaaacattagccaggtgtggtggcgcacacctgtaatcccagctactccggaggctgaggtgggagaatcgcttgaacccgggaggaggaggttgcagtgagctgagattgtgccactgcactccagcctgggccacagagcaagactccgcctcaaaaacaaacaaatatctatgatgtaccaaggcactctgctaggtgcaggggtgggtaggggatgatagcaggatgaattgtgtgggctctgctgtctcaaaatcacagtttagtggctgatagaggaaaacacattcatatggctactctactgtcatggctggtcactgcatacatttcttgggagtaagcatctgggagaagtgtctcaaaggtcctcacatacatgctgaatgaagacttgctggggcagggatggggaggtggctaggaggttggccagggcagggatccaggggtagaacagaggaggaggagcaggtaggggtaggggaacaatgccaagtctgcactggacacttggcactgagccctctggtaggagacatctagcaggcagctggcagtgccatctggagcttggcctgctcacagtctcccaaactggacacgtgtatttctatacatttgtcctttctgttttgtccactggtgacacccaccccacctatttcagtcactcaactgctaagcgcttttcttttctttattttttccttgagatggagtctcgctctgtcgcccaggctggagtgcaatggtgcgatcttggctgtctgcaaccactgcccgccttccaggttcaagcgattctcctgcctcagccccctgagtagctgggattacaggcgagcaccaccacacccggctaatgtttgtattttcagtagagacggggtttctccatgttggccagcctggtttcaaactcctgacctcaggcgatccactcacctcagcctcccaaaatctaagtgcttttcaaagccctgttccatggttccatgccagctcctctagcaagctcctcctggtggcttctgacccccatggcattctcattggactttctctgggctgcatgttatgtactatgtggttttatttacaatctcatgcactctgccatacattccttatctcatcctgaacatcttgctctttggagctatcatgctcccatgctatcatgggaacatagtttgcatttcatggagtgaactcagatttgcactcttacctgctgctgtagggccaatagtaaattagtataatctttcaggagaagagttaacagcatatgttgatatatataacaatatatatcttaagagaatctgtatctgttgacccccaaattttattccacaactccctcctaagaaaataatcagaaatatggccgggtgtggtggctcacgcctgtaatcccagtactttgggaggctgaggcaggcagatcacgaggtcaagagatcgagatcatcctggccaacatggtgaaaccccgcctctactaaaaatacaaaaaaattagctgggagcggtggcacatgcctgtagtcccagctactcgggaggctgaggcagaagaatcgcttgaacccaggagacggaggttgcagtgagccgagatagtgcccattgcacttcagcctggcaacagagcaagattctgtctcaaaccaaaaaaaaaaaaaaaaaaaaaaagaaaaagaaaaagaaaaagaaaataaccagaaatatgaacaatgacttatgtagggatatttacaccaacattatttgtcacagtggaaaaaaattggaaggaacttaaatgtctaacaacaggggaatggtttgagaaatcaggatactttgtgactgtataatcaatgtactaggatattattatagaaccaccataaagggtgtttttgaactagttagtgacatgagaaaatgcctgatataatgtcaaatgaagaaaggatatacaactgtgtgagtatcccagctactcaggaggccgaggcagaagaatcgcttgaacccgggaggcggaagcccctggttccccgtggggtgtgcgctcacctcggttttccttggccaggttgtcggccatctcccagtagtcgtagctgtgcaggatgctgttggtgatgctgacgtggttggccgccatctggtggatgcgctgtgggatgctgacgatggtcgacggggacagggcgctggcgttggagaggctgccctgagaccccacggagctggcgggagaggggttgggagacatgggggatggggttccagtgctcctggaaggggagaggtagaaaaaccagagtggcgaggtcgggagcaagcgaggcagggcagccccttggggaacagaaagcaaagcgcagtggcccagcaccatgcattgtctggcttacggcattgactttggaaaagcgaacttactttccactggccccccacggagatggggcttgggcggctttagatgagttctgcaagaaaataaaaacactgacagtgagtgccatctgcgtgaggtgaaacaggtgacatgaacgtgttttcaggtgactgcagagagaagcaaaggcagacactgcaggaaaaaggcaccttcagagaaactggacctgggaagtctccatcacagttctctgttccctttctggaagggagtcgggacagctgcctggacttcggaagtttaacagtatttctcttaaagggagttgctcttgaacattcctaagagaatatatttaaatgtatttccctagcagacaggatactcaaaagttctagtttatctgaatattctgatttagaagttattttgcatggacaaggtgcctgcatcagccctcagtgaggtaagtgaagggcttcacccacagcctgggtttttatgtacaaattttaggtaccacattaagtcataatcccaacggtctgttaaatcttgaagcagccttactttttcattgtaaattaatttttcttaaaaggaaaaaagagcaggaacaccctcatatctccccttatatacaatactttatatttaaaagtaggacatgtttgcagaaacagtcgacatacatttacttagtgcctgaaaatacatgacatcagattgtattgttttaacttaggaagtttaaaagtatttcttcttaaagtaagttgctgttgcatattcctaatagaattgattaaaatatatttccagaacagacaggatgttcaaacattctggtttatctgaatattctggtttaggaagttctgttgcacaagccaggtgcttgcatcagatatttaaaagttttgcctctagttagggaagttgctcaatgcacagttagatttcccctctgagaacccaatcatgccttcataggactgttaagggagaaagcggtctttgtgatgctgatgggagttttccccttccagagacaagaaaacagcctcagcctggttctccagagacaacatgtttcttttggttagaaagaactttatggagtggtgactgatttttctggttttagtgcgggtgttattaaaatggcaagaaatggcctgtcagaactctgaggtgctacaatggcaagatgtaaatgtaaggacaacaccgcaaaccatgccacttttacctgtgtcaggaaatacaattattttcatgaggagaattaggaaaccttcctgaacaggggagcttatcctccctttcttgacacaatgttactgacacctttctcaagctggtgctactggactgatcactttgtttccacttcatcctgtggttctgagaacgtgatctatagaatgcatgttctggatataagaacactaatggcagaaggggagaaaggcttgggggttgcagaaacagtccagtaaaggctactgaatggaggaagaaggcagtgactcacgcctgtaatcccagcactatgggaggctgaggtgggtggatcacctgaagtcaggagtctgagaccagcctggatgacatggtgaaaccccatctctactaaagatacaaaaaattggccgggtgtggtggcacacgcctgtaatcccaactacttgggaggctgagacagaatcgcttgaacctgggaggtggaggttagggtgagccaagattgtgccactgcactccagcctgggtgacggagcgagactccgtctcaaaaaaaaacaacaaaaaaagaagtcttgagttctcttcctctaccactaagccccatgcccaagaaataccggtaggaacaaagttctttttttttagagatagctctgtactgataaaacacatatagccaaattgtcttgggtacctaaagatttcatggtttctgaactcaaagtagcatttaaatagcccttgaggctgggtgtatggctcacattggtaatcctagcactttgggaggccaaggcagtaggctcgctggaggacaggagttcgagaagggtctggacaacacaaggagaccctctgtctacaaaaaatgaaaaaatgagctgggtgtggtggtgtgtatctgtggtctcagcgacttgggaggctgaggtgggaggactgcttgagcccaggaattcacagctgcagtgagctccgactgtaccactgcactctagcctgggcaacagaacgggacagaaaaaaaaaaaaagtccttgaaactttgtatccaagtttcagttatcaggaataagttctggagatctattgtatgggatggtgactacaattaataatgatatatagtatacttgaaaatctctaaaagaatcgattttaaatgttcccatcacaaaaacggtaagtatgtgaggtgatggatatgttaattagcttggtttaatcattccacaatgtataaatatatcaaaacatcacattatacataagtacacgcaatttgttgttgattaattaaaaaaattttaaaaatagcttttgatgaagggtaaatgacattaattccttgaggagcaactctgattttctggttgtgttttccttttttttttttttttttgagacaaagtctcactctgtcgcccaggctggagtgcagtggcgccatctctgctcactgcaacctctgcctcccgggttcaaacgattctcgtgcctcagcctccctagtagctaggattacagatgcctgccaccacgcctggcgtgttttctacccattctgtatgtattagtgggctgcagagaatattaagaacttgtatcccttaaaagtttgttgtagcccctggcggcttacagaattcagcttccttctttattcaagcattttccttgactgtaataattctctttagtagtagatcttacgttctggatttttgaacactattgatgttgactttaggcacctgaaggaaagggaaggctcagtgctggttcttgtcctgaagacacaggacggtcaatgggctgagaaagtgatgtccatggcctagcacctggttactctacatgcacaattggaaggcagtgtgctgaacataccccaggaacccccagcacagcctggccattagagatcacctctagaggaggttgggcatgaacagatctcaaatgatggttgtgtatctgacaaagggctgttggagatagagacggcataatttctagtttctatagataaacagagaagaggaccagaaatctcaaattaattattaatgtaaggtcgacctcacaacagtacatcagcgaaggcttttaaaaatttattctcccagtgaaaataatttcattccctgagataagtaaaaggtggcatggtttgcaattttatccctatagctacacactgctatctactgcttctgagttctaacaagccatctcttaccattttaaataacgccattaaaaattaaataagctactagagactggctaagagggaatggctctaaggggttacttctaaggaaaagaagctctaagtgagcatgaggaatttatgttagctataaagatgaatttcctaggacagtggaacgagtaactggatcttctttctcttgaagccataaaaatacctggacaaggctgggcgtggtggctcacacctgtattcctagcactctgggaggtggaggcggggagatcacctgaggtcaggagttcgagaccagcatgaccaacatggtgaaaccccatctctactaaaaatacaaaattagccaggcgtggtggtgtgcgcctgtaatctgagctacttgggaggctgaggcaggagaattgcttgaacccaggaggcggaggttgcagtgagccgagatcgcaccattgcactgcagcctgggcaacaaagagtgaaactctgtctccaaaaatacataaaaaaataaaaataaaaaaataaaaatacttggacaagaaggcagggagatacattagatgggctctcaaaggtccattctgaggcctgaaagccacaagtgtggcataaatggggttaccttggggaccagaggtgacctgcattaaccccaaagcaatggagtctaccaggtgcttcacaaatttgacagggagacaagtgaaattaaggaacaattctgctcattcactagacagtaccttgaaatagtcgattagtgcttttgaatactttacagcgtggtcccttttgagtcgaaacatccgccagtacaggagggccaggcatcggtaactgcaggcgaaaagagaaacaggcccagaagcggctgagtgcgtcgtgcgcaaacaagacttaaacatttttgttgttgttctaaggtactcaataacaataccttgtttctacataggaaatctttctatacgtgcatataatgtctgtgagggaacatcttttgtccaaaaatagaattcaaaattccaagaaggtattccataaatacatttatcactagataattttacagcattaggtgaatcactctgttgggtcacaggggccggccgcttccttcttccaccacgagagggcgctgtctctccacgagaggcgcgaggtagctctagtacgcagccttcactgcttcgcgggcgagccccgctctgcggaaaggacgacgctgccacctgatgttactgaactataagcagctccactaaagtcacaaacatgaatgtactttataaacaacaaaaacactatgctgggaataggtgccatcattataaacaacaaaaacactatgctgggaataggtgccatcattttattatttcctataatattttgtatacttatttatatatcagtattctatcttatataatcatattattgtcatttagtgtattattccaatatgggacttaaagtttgaaaggggcacaaaaggcgtttctgagacttatcctctcttccttggagctcttcactcagttatttgctaactcggatctgatgctgacatccagaataccaacattctgggtgcaatggcaccatctcctcctaccaaccaaatccaggacaggtaacaatttgagaccttttttgtgtctgttgctgttattattattttttaattcaactgtctttatttcactgcttggtagacatgtattctatcaacattctctgccttccacctactgatgagtaagaaagggctgacaggtaaaggaactataggttacccgatcgttcccttttttctgtggcatcattttcaaagtaagcggctgcgccgggtgcgatggctcacgcctgtaatcccagcactctgggaggctgaggcaggcagatcacttgaggtcaggagttcaagaccagcctgaccaacatggtgaaaccccatctctactaaaaatacaaaaattaggccgggcacagtggctcatgcctgtaatcccagcactttggtaggcctgtcgattttcaatcactgtgaattcagatcatgtatagtacggcagcaaaaaatggtctggactttccctggtcattagaactgctctggggctttgtatgttagaagacattgggcaaacactatgcctttcagcacctggtttgccaatgatggcatgcgaggctggggctgctattctaagcggagatgggcactcaccataatgcagccagttgtttgtcttctggtgtggcattggggcctgagtgggtttttagtctcatagcataccttagaaaaagcggggaggaggaatagaataaaaaacataaaaagcaaagaaatagtaaaactagcttttttattaacagaacttctatgatggtagttctccctgcctgatccttagcttttcatagtacttgctgataattctttcttaaaagctagctggtgctgctccattttcccaagtattacattactgtgatgactagaacagctactttctgctctttaacagtacaagttcaaatgctacagattgtcgggagtgataccagttcaagaactattcatgtatatgctaacatgtccatttttccacattttgatttatggctgagtgtctgacagatggaggtgaagttctatccttctgtgcttacctccagaagaatttccatcctgggtatgcagaggaatgcttagatttacccctctttctttgttatgtaacttttactttgacagctacataagtgtcctgagtacatttttaatctctgtttgcttctacagacagatactacgagaaactagtggcttttatggactgcacttaattccatttatttttctgaaccaaggggactgtggccattgctttctcccaacaacataccaaattacatatgcagactctttgagagagctgaggcagtatgtgtaatgatcagattgtcctaggttcaaatctcagctcagcgacttataagttgtaagtgcttagacaaatgtattaacatctttaagcctccatttccttatctataaaataagactaatactgccaatcacataacattgtgttaagaattaactaagatagcgtttgtaaagctcttgggatagttggctggcttgtaaattgctcaagaaacatactgttatcatcgcactatctcctcaacatgcagacttgtagcatttttcagtgttatctctttgcataatttttacagcggttgctctggattttacaatatacatgtaatttattggtatcaacattttatcactttgggatagtatggaagtcttacttcaatttagatacctttaccttccccacttaaaaatagcattgtcttgagtatcagatggtggtataattttttattgttttgttttgtagcagtggggtcttactatgttgtctgggctggtttcaaactcctggcctcaagctatcctcccagcttggcctcctaaagtgctgtaattacagatgtgagccactgtgcctggactgctggtataatttttgtttcaatcctcaaacctggtttataaactcataaggagtagtttattgtatatatatctatgtgtctgttcttccttctttcccaatgctcccatattccttcttttgtcattttatttctgtttgagaaacttcttttagccagtctttaagggtgggtcttttagagacacatacttgtacttttcctaaatctgaggctatctttatttcccttcattcttgaagaatagtttcactgactctagaattcatggcttcacagttccttctttgaacccttggaaactgtcacgccactccctcccagcctgcatggtttcagagaagcctgctgtcattcgaattgattctcccctgcagataattatcgtttctccctggctgctttcaggatatttggcctttagtttttggaaatgtaatcatggtgtgtttttgcatgcatttctttgggtttatcttatttaggtttttctctgcttcttaaatctgtaggtttatgtcttttgacaaatttggcaagtttcagccattatttcttcaaatactctctcagtcctactctctattcctctcctctgagacttccatgacacaaatgttggattttttcttattgtgcttgaggctgtgttcatttaattttttcagtctatttcttctttactgctcagattgggtaaattatattttttgtcctcaagttcattgactctctcctgtcatctccactctactactgagtccatttttggggtttatattatcaaattctacagtttcacaatttccatttagttctttttaaaataacttccatttctttgaaaagattttctggttttgtttgttgagtgataactgtgattattgaagcatttttacgatggctgctttaaaaatccttgtcagataattgcagcaactgattcatctttgcattgaggtcttctgatcatcttttttcatgccagtggtgactgtcctagttcttggtatgatgagtgagttcctatggtatcctggacattttgaccattaggttaggagactcttgagtcctattttaaacccagccaccctgtttaggtctagcaggaaggccctagcctactttgggggctgtggttccaatgataatttaattttcagagcctttctgatactattttagtctgtgtggttgatctggtgccaccggggcttcagctcatccctgatggtactgcctgcggagagtggaagggtgggaggagagggtcaccaggctgagctcgtgtggtggcagtgctccactgacccacgcctgcttggccatctggagttccctggtgaagggaattctgcccgtagggacaaagtgtacatcctgggctaggtcatcttggtggtgagaaccccttgccagcgctccaggcccttcagtgtctcagtaggggagaggagggtcaggcagggtgggcaatgtgcggatgtaattaatgctgttttcttttttttttttctttcttgagacagagtctcgctctgtcgcccaggctggagtgcagtggcgcgatcttggctcactgcgagctccgccttccaggttcacgccattctcctgcctcagcctcctgagtagctaggactacaggtgccggccaccacgcccggctaattttttgtatttttagtagagacggggtttcatcgtattagccaggatggtctcaatctcctgacctcatgctctgcctgcctcagcctcccaaagtgctgggattacaggcgtgagccaccgcgcccagaaaattaatgctattttctaatgtaggttgaaaaaagagctagccaggtgcggtggctcacgcttgtaatctcagcactttgggaggccgaagcaggcagagcacctgaggtcaggagttcaagaccatcctgaccaacatggagaaaccccatctctactaaaaatacaaaattagctggatgtggtggtgcatgcctgtaatccgagctactggggaggctgaggcaggagaatcacttgaactcgggaggcagaggttgtggtgagctgagattgtgccattgcactccagcctgggcagtaagagtgaaatttagtctcaaaaaaaaaaaaaaaaaaaaaaagaaagaaagaaaaagagccaaatttgtctttttgtctttgttttctctgtattttgcgtgattctatcgattctgaagtatctagaaggtggacagtgttctctacctgtgaaagattacttccatcagtgggcacagtgggtgtggtaccccagcaccctctctttgatggtatatctggctggcatggttttttgtttgtttgggcttgcttgtttgattttcaagtgtgaatgcctttaagcaggtcatgatactccagttcacagcaggccctatggcttgcttattcattgattccttaattgtttattaagcacatactatgtgccagaaaatattcgaagggctgaggattccccagttagcaaatcagacaaaacccaaaaaactccctgtgctcaaggtactcacactctagggcatcttccagctttgtccctgtccagtttctcccactttcctccctgcctgcctatgaacatctcaggctgggccttgttctgaggaaggaatgtatggatctaggatccgttagagtaacttttaccagtctttttactttgctgctttcatttcatcactactgaaagtaatgtgccatataaaaagacagtataaaggattcaccaatatattgatttagtagaaatactttattaagaaaaatgggcagtgttgactttaaaacattcttgaaaaatgctttatggaggtgatgtgttctctgatgtcggcatgacagtttcaaaggctggaaactatttactgagggaaagtggtgtgtaaaacaccaagtagcatctttgggccaatgtagaccaaaaagatcacatcctaagatgattagaaatcttccatgcagaatgtttggacatggtggaaaatgtctaagctttgattgcacagaaccccagaatcagaaaaacttttaaaagttagttttaggaagaattatttctcattatggatattagacattatgtcaagcagttaaactggctaaaaacataaaccatactatgaaggttctcagtagggctaatggatgaaattcccttaactgttggttacagagatgtgatggaggtgcctttccaggtctccatcatggaggataagtgtttgccatcgaatgccttgacacgtctgctcacaggtcttcacccaggtttggggatggtgcccatgtccagtttttagaccagacagtataagatggcttctccttccataaaatcctcctgaatgttcttccattaaatactccagaagtatttactgatggagctaagatttagatgatactaacctgaaccagatttttttttttttttaaagcagcctagggctgaaataggctcaaaatctgccacttcctagctgagaggagcaggcatgtcacagcccactcagactcagcctcctccctcagcaattgggggctacagcagctgccccccttgctcacggaggacagagggggcagggtgtgccaagacgccttgcacgaccttaccctcttattttggggggatgaacactggttcctggtgggggatggtgcaggctgacattcttttctctgtaaccatagtgcttccacacattcctcactcctcccctcatccagcaagaaaacacggtgcttacctgatgagctctactgtttctgaatacatcgtataaggagatttggattccatggggccttgttccattgcatttccacactcgataaacgacaatgctgcttcagcatagttcaaagcctttccaaacttttccacctgatcaacagagttaatacagtgtcttcctaaacaatagttttttttaaatggcattgtcatgtagtttatacaccttatttgagaaacccaactctgacttctaaaatcctatgaagctgagagaagaaagaaatagaatacttcttttcctacttattttctcaaactgctactggcttggagtaagtgagcgaacagttatatacagaattgtatcaaacccatgtgacagctgtcaatcaacagagctcagaactgcatggctgctctgatttctgtttccctctttctaacccctaatggtttggcgacttcattccttgttcctccatgctatgctaaatatgcatcaaagttggtaggtctggtcccatataagagttttcatacttcttttggtacatccccaacttggatggttctaggccttggttattatcttttacattatttgtggcacttatatctccatgccttcctcttctcaattttttttaatttttttatttttgagatggagtctccctgcaacctctgcctcctatgttcaagcgattctcctgcctcagcctcccacgtagctggaattacaggcaggcataggccaccacacctggcctcaattgttttttttttttgttgttgttaatatttagaacctcacttaagagtgagagtgagtaggggaaaggagaggagataaacctcaaggagctatttcagctttgctaaaataggacaaaaagttgaaaattattaataaaaatgatttttggttgggcctggcggctcatgcctgtaatcccagtgttttgggaaggtgaggcaggaggatcactcgagcctggaagtttgaggttccagtgagctatgatcgccccactgtgctccaacctggataacacagcaagacgctgtctctaaaggcaaaacaaaacacatttctacgggattatctgtagctgtcgaaatttgtgttattctttccccacatcagcaagggcagccacaaatcagctttatattcttaagatctcatcagtctaaacttatgcatcaagttcctggttccataccttactactctttgtaggtaattacatattctaactctggattgcagaatctccccagttttcaaatgattcattcatcaattaaaacagaatgacataatactcaaatactattccaagtcttgccactaaaaatacaaaaaaaacttcattagtaatgatagcttcaaaaccagaaatgcagagcaaaacttcctctccttagcaaatcaaaattttaaactgcttataaaggtagtgtaggctataatgcaacatttcttttttcttttttttttttttggagacagggtctcactctgtcacccaggctggagtgcagtggcatgatcttggctcattgcaatctctgcctcccgggttcaagcgagtcttctgtctcagcctcccaagtagctgggattacaggtgtgcaccaccacacctggctcatttttttttttttttttgtatttttagtagaaacagggtttcaccatgttggccaggctggtctcgaactcctgacctcaaatgatccacctgccttagcctcccaaagtgctgggattacaggtgtgagccaccgtgcctggcctataatgcaacatttcttgataacactttcagatgaagtcatttcatttagtattaatatttcctaaagcacccaattctgtggtatgtgcactccacaagcgaaagctctttccaggaacatataatagacttggagagagaaaatgtacacctacaagacagttcaaagtgcaaggcagtctgtgattacccaacaaaatacaaaatgaggcatccagtgcaaatgagatggaggaaagtgagctagtgatggggccgcagagaggctgggaaggccacagggaggagactgaatatgacgccgggaaggaatggtagggtttggctagatttggggaggatgctgagggtgtgagtgtgcccatgagagtgtgtgagagtgaatctctgcaggtgcaaaggcccgctggctggcaggagcaaggtgtgcttagaggtcagtaggggaccagcctggctggagcagagtgtctcctcttgggaaatcgtcaacaggaaagatagggttgggcaagaggacaatgaatgaataatgctgtaaactttagatgctggattcaggcagaaaatctctttctccttaaaaatctgatgctcttctccaagagtggccattcattggcttctccagatgaccagaactgtccatcagactcagattgtgtggacaagagctgtaccttccgctgccctcctctattttctgatacgtaggggttattcctcctgtaccccagtgtacataggcagtggtcttcacgtaaataagtgtttaataggtgacactggtagcattggaagaggggtactgttactgtttaaacatcttcagtattctgaaggtcactggaaatgccttcttcatttccagcacctgcctcaatctcagttatgaacactggaggagactaaaactggaattactaggtgggaagatgtccctttggacttcattcatttaagatggaacaaccacatgatctcttttagaaaagaaaacaaagttttccatctcttgcctgagagcttcaagctttccaaaacaggagatcatccaagcaagaaaagttattctttgaaaacatcaaatcatggtgactttagagtcttacgtgcagataatagtttctgtgttgtacagtttcagagaaagcattcatttcggcagatacatgtgaagaacacaagtgtttttgaaaagagatttgatcctgggaccaagccaagggtttgtcaggctaacaagagaaaaatgcaaatctagattttactttttaaaggaaaaaaaaatactaccgcccactgcctccactggctctagttactattcaaaccttaggactaaattgaaatattcatttgtctagggctttttcccagtcaggcattattggttgaagtcatactttattgggctatgaacatttgattatataaacatttctccattgaacagacccggccatccttgtaatagattttataattaccccagctatattgtcccagtgatgaagctgcagtacacacataatttggaagaacgtatctggaaagaaaagggtctcaccattgcatctgctttatgcttcattcgtttagcttcttgcataaaataatcggcactgcgaggcctacaaggagagaatgatattaaacgtcattatggcttaagtgcaacgtctttttaaaatattccttcctttcactcaaacttaaggcacaatttaaaaactctgcttaatgcggaattaagtgtgttttttgcctttccaaactactgcctgtatgtcaaataccacaatacattttctcttaagttagcaattcgaaacacactcaacatacgccagtagtctctatttacagtggatttaacatggccccctagggcctaatttgtgaatatatttttttattgtatggttaaaaaaaaagcgagaaatcttattttaggtaatatttacataaaacaatccccttttaatgtaaagattgtaaatatacctcataataattgtatggctatatatgggtgagtatatttatgtatccttatgaaaataagtgtcatttatatgcatatctagtacctagagttttatgtatatattgaattatcttaaagcctcacagtgaaaaataaaaagaggtaatgttggatgattacattccagttgtaatgaagttaattgtaaaatgatgtctaccttgtaacaatgcaaacatgccatgtattctctagagttctgattagctagctggtaaacattaacagcagacatgtggattattaaagcaataaccctggccagcggtgactctgccgggagatgaaggtaactcatccagagactgatttgagtgtgtgtaatgaggcccagttacgctaaggtactcattagacagtatctttaagtgtttagcccgatagattaaaaaaatgacatttttaggcaccggcagcataaactttatataatcaataaacttgacctattcatgaatatcaaatataagccaggactctctgaacgggagattcgacggaagtagtgatattaatcatggactgtttagccaatgattacatgcttattttgaactgccttatttcagatcctaatgggtcttttaccttattgtaatattaggtagtcagaacattcatgtatccaaagaggtcaaaacgcttagaaaagcaatgtgtgacaatgacattgcattttaatcaaacaaaccagaatcacagcatagttttggggtcaaaatgtttcctcaccccatccccatgcccccctctgagggctggagccgtccattcattgtggtgggtctttcactgagggtgaggcctgaggtctccttcctaggaaggccctgctcctgccactccgttttctctcttgcatctcctgggtgcccatgctttctccatatgaatggctttgttgttgccttggtgagttttccttctttgtccacatattgacacatattgtaagaatgtccatatattgtctggtctttggttccaactctggcaattgatgttatttttgttgttgttttttgagaaaggttctcactctgtcgcctaggctggagggcagtggtacaatcacccatactgcagcatcaaccacctggggttaagcgaccctcccaccacagcctcccaggtagctgggactacaggtgtgtgccactatgcctggctaactttttgtatttttagtggagacggggttttgccatgttgcaaaggctggtcttgaactcctgaggtcaagtgatccacctgcctcggcctcccaaagtgctgggattacatggcttccatcacatcaccatcctgctcacagacctaaaatcaatctccagggtctacgagataaaatctcagttcagatccccaataatcttgcccaacccacttaatcatattgcttactcacgaaggcccttgaccaaagtcagaggtggctcctcattgtcttgataacatggcatcctggtccgaggagctctgctcatcacttcccccacctggaacactctcctctctgttcattcactgagtgccttctaggagccgaatgttgcctggccctcaatttcccccgccgtaaggcgttccgagtaaccttggtccatgttcccctctgtccttcctgagctcacacagcacttcttgtttactacacttggtatttcattatcttctgagctgtactgggcatgtgtgcaacttgattgctggtacgtttttagtaaggaccatgctgtagacttctttgatctttcccaccctgtagtttttggcacacggtagaaggtaagcaggtctcccttgaatgaatggcactgaattcattttgagcttagaaaagagtggtgccttccgatggggtgcagcatcgcatccaatgagccagagagtgtctccatggcaacctgaaattctccacatcattatctgttctatactctagtatataagttaggtcattttttttttcttgccctgttttgtcactaacagttcactacttcaaatgcatttcattaaaggattatcttggtaataagctatggtatcttagtttccaccagccttctaagttacccttatggatggcagtggctcacaattcctaatataagctccttaatcaatattgttttcatctgcagcataggggcatatttttaaatcctgatatggaggctgagtcacagactctcaccatagcacatgtgggtaagtaacacacctaattttctgaccgtatcagagcagctataatcagagcagtaacctgagatgctaatagcataggtaccatctggaggccacttaacgaacacatttgttagaactctcatctttgcatagaatggagggctcactataatgagtcactgaagattgcctgatgattggcccattttctcctttcgagtgatttctagtgctgtacttccagagcagatcattataaagccagcaggaccaatgggatgtcacccagtgtccagccttgccacgaatcacaaaggcatcccttctgacagcaatacacaagtcagtaggaaaagtaaaattgcttgtcaccattgtgacagttatagaatataatacagcaaaggtactaaaatgagatcttatctgagtgttcaaatagattttccatctaatcttctattttttttttaacatggaaaacctagagttttcatttttcatttgtgtaataaaattcttcccattgtttcccacagtgatggtattttatgatgacacatgagcaaacctaataaaagtttaattaaacaccataaatggaactaactgtgaatcatgggctcttcagaaacggggcttgagtgatctgaaagccagagcttagctgcatgcatcttcattatgagagctctctccaacaaaagcattctgagcacttgatccaaatagaatgttttcttttcttctcttccccctcccaccacccccccccccccacctagaaacacacggtcttggttctcagcagcatcagggtttgagctacccccatatttcttctggcatgggaatattaaagcaaccttgctttttgttctcctttgtggccgggatagagttgaatggtctcccacggagagcctggcagactcctttctgtaattcctacctctgtgaaatgccgccctcagtagagccagcctgttttgtgaaaactggcagggatgagagctcaatgtgtttgaacaacaagttcctcggcgcggcagaaattggatgattttcttagggaagttgaaatccaaatcagacaaataggcaactgcataccaaatgaattcatcatctgctatccgatatgtcagcttgtcatctgataagccccagaggtgttaatatgtcccaagctttgaggagaatgcataagaaattaagtaattatttttaatacacagagtcagtgaagactatggatgagggcacttcagagtcagccactccaggatgctggcactgcctttataggcacttccccacagatccaggtagattgcatttgggtagcaaggattcaaacacagcttttatttccacaactttgatgtcggctggggctcagagtccctggaaccgggcttctcccaggcacaagcggtcattcactgtttcttcaggccacaggactgcttccctctcagccggccacagaaggcagggtttgctctgcaggacgctcaggctaagtggggcgggtgttgaatcaaaagtaactttctgttgaaatgggaaattatcaatctgatggttgtttttctctgagtgtgacatttaaaataatcttacaaaaccctaaagatgattggacagctgagatttcaatccaggagatctgaatgtccttgtctccgcaccctgtcccccgcacccctttgcaaatcctacttcatttctttctctctctctctcactcactcttactctctcactctgttttggttagaacaaaagaagctcctggccttgagacagggatttcataatgggagaaattccatatgaagaccaataaaggcttaatgattaatcaggaaaacaaaaaggtagggtccctgctttgaaaggactaggagaggagaccctcaagagaacatgcccactgcaagcccctggtgggggagcgccttcccagctgcaatttcgcctactcaaggatcttaattggtgtcctttgactaaatcatgctgctagggattcaaccttttacaatatgcgagtattcccatcctctataaaattaaaatcctttagctctgagactgctgtgcaagtacattacaaatgtcaagtccctcttccttcctcccggccacatttcacatgccatggccttcagcgcctggcgtctatagtcagtctttcctcactgtcgggaggttcaggtagccgggctcctgttacgggcaccatggggacagaagggacgtttggtggtttggctgaatgtgctgattgtgactgacttttccatgtgacatacaggcagcagccagcacttcctccagggagcggcaggcagccctggcacctggggttctctggcttcctagcacagcagaacggtgggcaggatggaggaggtggttttccagccaagcatctcaccaccacttagccctgttcaggacttctgtacggaggccttcatgacacagttgttctctctcaattttccccagccaagaattcccctgtcactaattatgataccaagtaacttacagctcatggctttgcactaataagatcagtttctaggcctcaagttgaatcaagtgttgtcattcattgacacaaattcttacagatccgttttttaaacaaaagtttgataaccacactagtgtcaccttaatactgtggctgtcaagtagtgaatgttgtgcgtttgcttaatgtcaggggaggaggtgaggtcacactgccaccaatatgagcccacaacatacaaaggacaggctgacctgattacatttttaaaaataaatgttattcttctcagttctgtctgtatcccaaaggaactaactggtgcctgtttacaggcattatagggattacaggcacatgctaacacgcccggctgattttttggtaagtaacctaggaaaacgggcttggaaacccattaatttacattcacctgcatgtagattccttatagtcatagaaaaaaaaaattgcaggcactcttccctgggaatgtaatttataattcagctgggttcattcaacacttgttattgagagcctactggcttcagctgttgtctgaatcccatgtttattcaaccattaacaagtatttataatacaaagagatgagtttacttttttaaaaaagctgcatgatgcggctttaaaaattaaatgacagtgtggcatctgttactttttggatcactgtaactggatttccatcaactcgaaatcactccagtgttaattatctagtcttttcttccactggtggcctctctttggtcatttcactgcttgtttttacaaatggctgaagttcactcttcaccctcggtgaagagaagtcaagggaggtgacagggctgaggtcttcctctgtcactgaggctgctggtggggaagctggcacagaatggaggtgggcaggaaggaggccgagaattaaatttagtaatcctaggaaaccttcctggagaggtcatcatgtgcctctctctcccctgaagaactgagaattaattaatcattatacttcagctcttgtgcctgtacttggcacttagtaagtgctccatatgtaccaaaaggaacctgggagacgttttgcacaattttaggtgacattctagcccagtgatctcttgaaggttgcttatttttactgcttaaaggaagagacgatgcctatttttgcttttttttctttaagatggagtttcactcttgttgcccagattggagtgcaatggcatgatctcggctcactgcaacctccgcttcctgggttcaagtgattctcctgcctcagcctcctgagtagctgggattacaggtgcctggctaattttttttttttttttttgtatttttagtagagatggggtttcactgtgttggccaggctcgtctcaagctcctgacctcaagtgatccacccacctcggctcccccaagtgctgggattacaggcatgagccaccgcgcctggcctatttttgcttttcaagcttgaagaatctttccacaactttcttagttcgatggttgagtggctgtttgagttgcatgtttattttactgttatggatttcaaatcagttgggacatatggcaattggaatgcgacatctatctctccatatgatggatatgtaacagtgtttttttattctattatatctatatccataaaaggagaaacagtttcattgtagctgtcagccaggaaaattatacacattgctaatgggaagaacaaatgataacagcctctttgttgacaccaatagtgacaagattatattagtttcagccatagcagattaagaaacatttcctcttataaaaagtccaagggctgccagccacggtggctcacgcctataatcctgcactttgggaggctggggtgggagggttgtttgaggccaggagttcgagaccagcctggacaacatagtgagacatgattttttttttttttgagacacagtctcgctgttgcccaggctgaagagtggtagcacgatctcagcttactgcagcctccacctcccaggttcaagcaattctctgcctcagcctccggagtagctgagattacaggtgcctgccaccacacctggctaattgttgtatttttagtagagacaagatttcaccatcttggccaggctggtcttgaactcctgacctagtgattcacctgccccagtctcccaaagtgctgggattacaggtgtgagccactgcgcccagccgtgagacgctttttctacaaaaaaaaaaaaaaaaatttaactgggtgtggtagcatgcatctgtagacccagctactcaggaggctgaggcaagaagatagcgtaagcccaggagtttgaggctgcactgagccatgctcataccactgcactctagcctgcgtgacagggcaagaccctgtctcaaaaaaaaaaaaaaaaaaaaagtccaagtacctgtagatcaaagtacaatcatttagttgttgctgtttctgacctagctttctggttcatacactggaaaattccttgcattttaatatgacatatgtgtttgtattttgtgtgtatataccatgctctcaaaaccacccactgcaagtatgcggtggtgtgagtacctcagggtctaatgctccttctgtttgatcatgttgttgggttatgacttccaaatgcaaatttctatgttatccttatatacaattttaatctcttctttttacaaatggctgaagttcacatgaacaatttatatcactgaaccctaattataaatgtagttggccacctgactgtactcccactccatgccctccctggggggttaatcaccacctacctccctggctgcttggcaaaggcgatgaagacagtgagaggaagcggggtggtgagggccaggagtgtgtgtggggtgggacgcagctgccaccacaggaagagaagaaacacacatgccctcctgggctgccctcaagccttcctaaacccagttaccttggaatgtgttcatttaacaaaacaaacaacaaatgtggatttggctttcacccccaaaaccctgtgccctaattagcttacaggagttcatgcaatacttgaagactaaaacttagtattttaaatttcccagggaattgtacagaggtgaataaatagatcatgccgagactccgggtggcagttagggatggaggagcggggcggacgatgaggctggagtagccacccctgcatggtgctttctgtgctccatgtgacaccccttaggagacggcatttaatggatcctaggagggccccgctgagcgagctgtggcatttgtcactgggactcttggacatgtagagccattttattttccagtgtccagtggggttagtggtttgtagtctgctcctcagctggactggaagccctcagagggcagaagtgcctatttctgctgctgctccaccccagagctgaatttttccttgttcacccagccatgtatttgacgcccgtaggactgctaaagctgaaaagaggattcttctgccttccaggcttgtccttgacacatacattttccctacgagccgaaataattttcagcatcattttatcatttctcatttgtcattttcagcctctcgagagcattccaggatgttgtttttattcatcttctcctcttgtttttcctccttttaaaatgatgctgggaatggaagttatacttgtgtgaaactgaaagtgctagaattgggtgaaggatgatggcatttttcttcctatataagaatcatttatactatgataaagaatatagcagttggaggaaaaaagctttcaggagtaaaacactattattcattgcctattataatttacaaaaacaacaatgcttctctttctagtagcataaaaccgccaacagcccaagtacaagtgcttagaagtgtaagactcattaatgctatttgcctttgttttttgatgtcctggatccaaccccattagcactgattattccgtctacccaaaaaccccaccaggactcaggcgtgcactcaaaattaaggctccaattccattcaagagggacatttaaatgaccaagtcccaggggaaaaaaaggccgcactgtagctgaaggtggccacaccaaggtgcccatgccccttccacctgagcagcttctgttctgtcttgcccctcaccacatttaaaagcgtctgaacttacatatcatcgaagacaagtttctgcctcttgcagtccctgtggccgttggagcctggagaccacggcttcgtctgcggccgtgacttgtggaggggaatgttttcagaattgttgtgagctgctttctaaacaacaaacaacacacatctttgagaaattggccacctggtgaagcgagcagcccatcacatacatacatacgtagaatatctttggctctacagaacatctttgtgtgctgtattagaattgatggtgattttgtctcaataaagaaatacatgcattctaggtatttgctgagggcttctacctgtgttctcaactgtcattcttatgacactatcaaaagggaagtcatgacgcctactctcacagatccagaaacaggcttggtgaggttcagcaagttgcccacactcagtgactgtggtggaggccaggggttagggtttagatgcccacttttcccagtccgctagactggaggctggccagttcagtcttcatcagcatcctccagggggctggtgaaaacacagattgccaggccccaccctgagagtctgggattcagcagggctggggtggggacctagaatctgcctttccatctggttcccggtgatgcggatgctgtaatcacccatgatcctggaaccacgctttcagaaccattcactcatctcaacagtcaaccagtcactcatctcacaggtttgctggttcttgttggctgtctgtgaagaccagaaggagtcaacaggaatcactaggaattacttaaaaaataaatcgactgggcacggtgtctcacacctgtaatcccagcactttgggaggctgaggcagggagatcacctgaggtcaggagttcgaggccagactgaccaacatggtgaaactccgtctctactaaaaatacaaaattagctagacgtggtgatacatgcctgcaatcccagctactcgggaggctgaggcaggagaatcgcttgaaacctggaggcagaggttgcggtgagccgagaccatgccattgcactccagcctgggcaacaagagtgaaactccgtctcaaaaaaaaaaaaaaataaataaataaattctaggccaggcatggtggctcacacctgtaatcccagcactttgggaggccaaggcaggtagattacctgaggtcaggagttcaagaccagcctggccaacatggcaaaaccctgtctctactaaaaatacaaaatttagccaggcgtggtggtaggtgcctgtaatcccagctactcaggaggctgaggcaggagaatcgtttgaacctgggaggtggaggttgcagtgagccaagactgcaccattgcactccagcctggacaagaacaaaactgcatctcaaatatatatgtatacatatgtgtgtgtgtatatatatatatatggaacacactagtctgtggaaaagttttaaaaatcacattacttgggatacagacatttacatggcacctattgtgtgccaaacacatggatcataaaacaatgtcagtggttaggaaatgcaaatggtttctctgaagtaattaaattgagtgtatacaaatgcttctttaaatagggactgcttttacgtgtagcactgtaagggttagagtctactgtcatagaagaccaggaagctcagatgtcaacattttaaaattgttcttaaactcctccagtggcctctgcttgctcttggtaaaaggagcgatcccagccaagtggcccctcagccattctttgcctgtggcctctgttccccagattcatgagcgtgtgcagttctttctcgggacctctgcacttgctgcttcctctgcctgtaatgctctttgtctcttagtatatggtgacttgccttttagagatctcgcatcaggggtcagccatctatggccagggagtcaaatctggccctttttttaaaataaagttttactgtaaaccaatcctgcctatgtatttatctactgtctgctttcctgctacaacagcagagttgagtagctgggatggagactgtgcagcccataaacccttaaattatttatctgactctttacagcagcagttctcaactggggcaagttgacaatgcccggagacatttttagttgtcaccactgcgagtgggtgctcatagcatctactgggtggaggccagggatgctgccaaacatcctacgttgcacaggacagccccaccacaagtaattactcagtccaaaatgtgaaaacctgcttcgcagaggccgggcgcggtggctcatgcctgtaatcccagcactttgggaggctgaggcgggcagatcacgaggtcaggagatcgagaccatcctggctaacatggtgaaaacccgtctctactaaaaaaatacaaaaaattagccctgggcgtggtggccggcgcctgtagtcccagctactcgggaggctgaggcagaagaatggcgtgaacctaggaggtggagcttgcagtgagccgaggtcgcgccactgcattccagtctgggtgacagagcgagactccgtctcaaaaaaaacccaaaaaacctgctttgcagaaagtttgccactcctaggactaattcaagctgctttgttataagagctcctagttctttgtgagttccctttttagtactgaaaccattggtggtgaatcatgcatgtgtgtgatcccctgtataaggctctctccctagaactgtaagcttcatgggggcacaaatgggatccgctggattgttattgcatctctggtgctcagcacagtgcccagcacgtaataagtacttaccgaatgagcacctcttcggtgaaaaataactaaataaaatctacaattggtttatagttctctgcgtatcatagttgctcatgatataaggatatagagggaaataaaaaaacttgagttggtggctttttgttccatgtttttctaatataggtcttccccaattctttcagtctagaattaaagaccactgctcccaagtgagggtgcacaaaaaaggttcatttcctgaggatgctgtaagatttaggctctcgtgggaacttccagcaacttgtaataatctttaattcatgggataaagtgttacacactgctccctccctcatctttctcatctttctttgcagaatcctgttcttttttttttttttgagacagagtctcgctctgtcacccaggctgcagtgcagtggtgcaatctcggctcactgtaacctccacctcccaggttcaagcgattctcctgcttcagcctcctgagtagctgagattacaggcatgtgccaccacgcttggccacccagctggttgtgataggcacagtgattatgacaggggagggtttggaagtaactaatgttcctgaaaggatgagtggtccaggaccactggctgttagaggctggcatggcagtgaagaggaactaacatgtagtgttagttgcttaggcgtccctaggtgttggagtttttttttttttttttttgagacagagtcttgctgtgtcgcccaggctggagtgcagtgccgagatctcagctcactgcaacctccacctcccaggttcaagcaattctactacctcagcctcctgaatagctgggactacaggcgcctgccaccacgctaggctaatttttgtattttcagtatagatggggtttcaccatgttggccaggctggtcttgaactcctgacctcaggcgatccgcccgccgcagcctcccaaagtgctgggattacaggcatgagccaccacgcccggtcggggtcttttcatgatattgtctcttttaagtcttatcactaccattttgcaggtaaagaaacaggagcagagagattaagcaactggcccaagatcacactgcagctaagaggtgaggtcagattgtgaacccaagtcccctgctcttcccctggggcgtgctggaatcacccgagatcactggaaaaggggtggtggtgggggtcccccactgcagctgcgacactggccaataagggcagagtgggggccctgtagctttcagtgtggggtttcaatcccagatttaactctgccctgggataagaaatttttcccaacagaaagattggttggttcaaactcctaatttactttgtcccgggatggtattactttgaggtcttttcttttcagaaggaaaaataaaatcttgcctaagcaaccgagggttagaactctccctcagggttcttcttccccgctctctgttgggacagtgaagggggctgtcctctgttgggtcttcctagaagcgggaggcattcaggaattctcaagggacctcaagcatgtgttcagactgtgctaggttagagacagagcttgggggtgctcaatttcattttggttttaattgggaaaggaagagcatcaacaaaccgtgaggtctccgccgtgaggctgcagctggctgtcggccttaggctttttgctggaagaggctgaagtaaacaaactgttgccattaggtcggctggaagaagttaagtcctcgctggtgtatttgtgtttagatgcatcagagaggggtgagatgggcgaccgaagcattttttcatttttatttattggtattgccacactgaaaaaggaaattacggtaatggaatgttacagagtcagcacagggaaaggtaaatgttttcatatgacccaaaccacccaactgggacctgttggtaggagaagcttattgggaattattataccaggaaacaagttaatggcattaggatcataacaaacaataagcaaatctcactcactctttcttttctcttcccatcaggatgagtagtaattctggagccagcaccaaagtacacgactaagactaataacaccttcattttccaagtcctttatccaaggatctcaaaatacccaacaaacaacttactgttttcctaacaagcataaggagcaagcagtgggaaagtcaatcaacaacaataaatgaattctacatttctgtctttttttgagacgggatctggctctgctgcccaggctggagagcagtggcaggatcttggctcactgtagccctaacctcctgggctcaggcaatcctcccacttcagcctcctgagtagcagggactacaggtatgcatcaccacaccgggctaatttttcatattttttgtagagatagggtttcaccatgttgcccaagctggtctcgaactcctggattcaaggtgcctcggcctcccaaagtgctgggattacagacatgagccatcgtgcccagccaaattctacacttctttttattttttatttttttgagatggagtttcgctcttgtcacccaggctggagtgcaatggcacaatcttggctcactgcagcctctgcctcctgggttcaagtgattttcctgcctcagcctcccgaggactcccgagtagctgggattacaggtgcctgccaccacatccagctactttttgtatttttagtagagacggggtttcaccatgtcagccaggctggtcttgaacttctaatctcaggtgatccacctgcctcggcctcccaaagtgctgggattacaggcgtgagctaccgtgcccagtccatattccacatttctaaaaagacttttgctatctcatctgagcttgtactaaatataatatagaaaaataataaaaccagagaacaacctgcaatatgtgaagccaattcttaatatctgagtttatgacttaaccagggattgatcagattaaacctagaatataaaaacggtgagtaggaggccgggtgtggtggctcacgcctgtaatcccagcactttgggaggccaaggtgggcgtatcacttgaggtcgggagttcgagaccagcctggccaacacggtgaaaccccctctctgctaaaaatacaaaaattagccgggtgtggtggcgcatgcctgtaatcccagctactcagctcaggaggctgaggcaggagaatcgcttgggagaggtggacgttgcagtgaggcgagattgcgccactgcactccagcatgggcgacagaataagactccgtctccaaaataaatacataaataaataaaataataaataaaaatggtgagtagaagttacagtttctgattcctaactccttattttaccttcaaaactactgtctgtgcttgaatgtaacattctccaaaatcaaccatcagtgaagagggattcacttatatctgagtttgcaatgtatattatattgttaggcctctattacttaaaagtattgtttggggaagacagattagtttgaaataaactcagtcatcactaatttaggatacttccagaggtcacctggtagagtcagttaaaaaatggtaaagccatctaacaaagatttactcattattcttggggttgggatctcttaattgcacgtgttggttatcaccgcaaagaagccactaaagtcacttcgaaaagcaatttccttagctggtggtcacagtggagaaattacaaacacagacctctagaacaaatgacaaaaccaaggttctgaatgttatgcaaatggatacatgtggggatagcatttctggtgaaaagcactgttccaaaagcacggtgtgtctaacaacatagaggctgtgtcacgcaaaagtgctttgggagaatcaaaagttgctcatctagtgatggctaagatgctgatgctgaagataatgcgaacagcctgattataattgtttctcgaaatgtgagtgaagaaagaccttttcctcagtctctattatttgacatactttatgatttttacagtgcatggaaaacaaaactgtgacattaaatattatcatggatatcatgattgcctgtttttcatcactgcaagtttatatatatattcaagttggccaaagaaactttctttggagctcttctttgaaattggcaatccccttctcttggactgctgtacagcactggtaaaacttgatagtagtaatcacaattccagaggtacacagaccacctttctcagaatgtactctaagcattttatatgcattgtgtcaccacttaacagcaacaaaaccatcagaactaagaggctcttccaggctaagtctctagagcaagagttttttaacctggggtccaataacttgaatagagaagtgacctcttcattttcactaacctctcactgtaacagaacatttccttcaactatgagtaaaggtatgaaaccagagtcatggtttagcaggagcagtagtacaacacttgagaccgtgtcaccggtataaatcacagctattttctttttttctttttcttttcttttttgagatggaacctctctgtcgcccaggctggagtgccatggcacaatctcggctccctgcaacctctgcctcccgggtttgagcgattctctggcctcagcctcccaagtagctgggactacaggagtgtgccaccacacccagctaatttttttatatttttagtagatacggggtttcaccatattggccaggctggtcttgaactcctgaccttgtgatccgcccgcctcagcctcccaaagtgctgggattacaggcgtgagccaccgcacccggccaaatcacagctattttcatatcatattgcagttgtgcatacatacggtttatattcctcactgcttagaaattctggaagccaccagatcagctagaaaggttatttagtgcattaacaagcactaaaggatatcacacatttaaaaatatttggggactacattttccccatttcccctttcccaatattttgggctggcatccaccctgcaaagaggaccgaggagtgggcagcatgcaggggcagccctccctcctgctcagacccacaggagccctcgcctttcaaggtgattccggcgctgcagtgtgcctgtgtgtgtgcaccctcaccctccagttccctcgccaagttttagcactgctctacatcttttcctaacctttcagtttacatttttatgtgttgtgccgagacattcatctctcttcaaaattctatgtatacggtcagggagggtgaggagtgtcttagagaggaaaagtggtttccgtgctgtggtatttcaaaatggaaagagcttctacgactgatgataagctacttgtttctaataaatacctgggatcttgctttgcttgtaagccattcatcacagaggggagtcagtgctggatgcgtccatctggaacctcttgagaggagtgtgtgggtggccatttaaccttgggagcacggacccttctaaggccacaattttagtctatatccaattaattgctttaggtgctacacatggagattcagcttgaagtgtgtatttcttcgtctgtgtaataagcttagtgttcttaggagtttagcggttaccattaaaatattgattagaaattcagttattaagtttttttgggggaagggcatgtcttggggagtgcagagctgtgtgtaactagtatctggtctttggttatggagaagaaccttgcgtgagtatctggagctataatgtgtggcacatgtgtagccataataataagatttgggttaaaggagggaagcaagtctgcagaccttgaccagagtagtcctcaaaaagcctgaccctcctccaacatagcaggtgactttcagacccagagatctctccagctcacttccactttggagggaatgcacgtacctgttgatgttcatgttgcagtggtttgcagacaaagtattactggtggaggtggccagtcttgaagagctgtctttctctccctgggacttcttgatctccctgtagtcgtcttcgttgtcacactgtatgggaataaactaaagtcaatcagcactggatttcaagaggtattatgagttcccaggcaccgacttccacagagcaaggcctcctgggagccccactcacctggcttccccgaagcacagcctgagcagctgtgcccctgccatagcttccccattagctcctcaacaagcaaggatgaaatctgtcagttttacaattgacagctgatggagaggagaggcacgacgccatgattcaacattttgaattctgaaagctgctctgccatcaaccggcttaggatttagccctccaactggtctgagttcccactgcagctccagcggcactcaccttggcatttcttggtatcagaataaagtacagcaagtgtgtgttctctgggattcatgccataagggcagtggcaagcctggacttttctgttttaaaaattcttgctttggccaggtgcggtggctcatgcctgtaatcccagcactttgggaggccgaggcaggcgaatcacgaggtcaggagatcaacaccatcctggccaacatggtgaaaccccatctctactaaaatacaaaaaattagccaggtgtggtggtgcacgcctgtagtcccagctacttgggaggctgaggcaggagaatcgcttgaacctgggaggcagagatttaagtgagctgagatcacgccactgcactccagcctggtgacagagtgagactccgtctcaaaaaaaaaaaaaaaaattattgccttttgtgaactgcaagcagaagctattatctcttggtgccttaattctagttttcaattactatcccatgacatcttagaatccataaagtacctttttctaaaacagtactttgattggatccttgttgccatgattgggtttaattttatttgtttatttagagacagtcttgctctgtcacccaggctggagtgcagtggtgcgatcatggctcactgcagcctcgacctcccaggctcaggtgatcctcccgcctcagccttccaagtagctgggaatgcaagtgtgtgccaccatgcctggctaattttttgtattttttgtagagacggggctttgccatgttgctcaggctgatctcaaactcctgggctcaagcgatcctcccaccttggcctcccaaagtgctgggattacaggtgtcagctatcaggccagcctgtgtttaactttagatatgtgttaaggtgcaacacaaatatattcagaaagtaccattttccatgagataacaggaacctagtatggtatcctcagggctgtctgcattgttttccaggagacaagtgccaacaccaaagagagaaagactctgactttctcgctctggctgggattttgccacacagcctctgccacaggggctcccagatgcccacactgtaatagtacccccatggagggcccaaaccaaagctccgagttcttagtccttagctccagggctccagcagggcgagactccacaaatttgacagccaggtctatggggtcccatctccagcacccagtactggggtactaatgcccagaataccaagtaaagagcactataagaatgttctttcacttctcttgtgtctgtgtttaatgattctttagattttatgagtacagccaggtgtcaggcttactgtaaatgaagcttcttaagttaaaataaaaatggccataagtaatacaactatttaaacacagaatattacggaattttatgtaagtctttctgcacatctctctagtaaactctgcatgcctggatggctttatgtatttccaatctgtctatatattaccaatgtctatctctgcatatttcatgtgtatatttccatcagcgtattcagttagccatccatcccagaggtaatagccacactcattcccagatgattaactgattgattgattcctacactcaacaaagactgagcaccagcaagtagtaaggaagacagggtgtgtagagaaaaacaggaggaatagcaggtagggaagaaaatgagctgccaagtattactgagttgcattgttggaacatattgtgtgaatctgacaacacccctgcaaagatgtcaacatttttttttttttttttttttttgagacagagtctcactctattgccaggctggagtgcaatggcatgatctcagctcagtgcagcctctgcctccagggttcaagcgattctcctgcctcagcctcctgagtagctgggattacaggcacgcgccaccacgcccagctatttttgtatttttagtagagacagggtttcaccatgttggccaggatggtctcgatctcttgatctcgtgatctgcccaccttggcctcccaaagtgctgtgattataggagtaagccaccacggccggcccagatgtcagcattttctagatggagaaactgatgttcagagaaagtaaggtcacctgattaaggtcactgaggaggccaaggaccataaataaccttctgggtctagcgcaaaatgaaaacgctgggccctttgttcaaaaagcaggaaaagagtgatgttataaagccctcaaatagaaaacattctccattctttcacagtctctgtcatggaggtgtctacagtatttgctatacacactgtacttctttgggcatggggatacttggggaggcaagtgtagcctctcaagggctctgtctgcccttggacaaggtatatgtgtgcagcccaccagtgtgggcgttccccttctgccaatcagaggccctacctgtggtgcccgagttgtcaggcatttccccaacaacccacagcaagtgggcaacccccaggggatttcaagaccctctttggaatgtcttactacctggatgagggatgggcaagattcttcctctgcctgcacctaggccccttcttggggcaagggcagcaatagtccctggactaagacaggaagtgggaggctgcctagggcccagggtgccaggaggcagaagcgcaggcagaacctgccctgcagaaacaggcaggaggtgggaacacagtgagtcaaagctccatatgcccctgcacatgtaccatcaatttgcagcatcacaaattcaaagattacaggaaaaattttaagatggcagccacaagcattcaattccaaggggccctgggtgatgcacaccactatggtcccatgcatggggcccatgaaaagctggacctgcaggagggaaacggtaaagacaggatttgaagtcaggacactttggtgtgaaaatccacacactttccattatatgtgagcactctcagggcaatggggaccaactaagggcgcccactgccggctaataatggccagtgctgggtggaaactatgttggggcctctttataaaattatctttgctggccacgtgcagtggctcatgcctgtaatcccagcactttaggaggccgaggcaggcggatcacctgaggttgggagttcgagaccagcctgaccaacaatggtgaaaccccgtctgtactaaaaataccaaattagccaggcatggtggcacatgcctgtaatccaagctactcgggaggctgaggcaggagaatcacttgaacccaggaggcggaggttgtggtgagccaagatggtggagcatcattgcactccagcctgggcaacaagagcgaaactctgtctcaaaaaaaaaaaaaaaaatttttttttctttgcatccataccaaggaaaagcaaaaagctgccccttgaacatatttcttttcatgaactttcttgcaagggcttcaaattctactttatagggataaattacttaatgttattaatattatgtgaagaaaaacatcctttggtactttattttttattttatttatttatttctttgagatggcgtcttgctctgttgcctaggctggagtgcagtggcatgatcttggctcactgcaacctccgcctcccaggttcaagtgattctcctgtctcagctgcctgagtagctgggactacaggtgtgcaccatcatgtctggctaattttttgtattttagtagagatgggattttaccatgttgtccaggctggtcttgaactcctgagctcaggcaatccgcccatctcagcctcccaaagtgctaggattagaggcttgagccaccgtacccggtctggtactttagaatgaatttctctggtcataggtgcccttaggttacaaagatgattgtcataaaaaggagactgagtgccttctccatgcgcacttacaaagcaagaaatatattcatcgtggccaggacaaggtaacaagctgtactccttagtccccttctcaatcagggattcgaaatagctgtgaaacgtatgtgtccagtctaacttttctattgatagactagactgtcttcagaaaactggaaaatatacagacctcagactgatttcttattgtgacgctctgaagccagacagcctgggttaattcctggctcagccccttaggacctatgtaaccttgggcaagttgctttaggctctctgagcctctgttccctctccgtaaaatgggtatgacaatatttgcctcataaagttataaggatgaaatgatttaacatgtataaagtgcctagagcagcatctgtcatggggacctatatacctgtgagctgttgttactgaaaactttgtcctaaatttggagccatccatgcatattgcaatcttggtctgtcacccattgtatttttcacagtgataaaaattacttatgaagatacagtaacaggaggggttaaaaaccctcaaaattggctttaatggatgattaaggtattcccctgcacaaaaaccttcgaaatgggctacacgttcaggctctgctgccagagatgccccccagctctccctgtccttgcttttgctgcccttctcactccctggactcaccgcttccattcctgaccctggacgtattcaaatatccctcctctacagagccctgttttcagggcccctccaccatgaagccctccttgatcaatgctaacagaagcaacagctgctggttctgatgctgcatcagggtctgccgtattcattttcacctgccacaaccttgaacttcatgaggccactggcctcttgggccaatgagtgatcccaccatcaatgtcaccccattcctgccagcaaagagtgagggttctcatgtgtttagctttctcacaggccctacatccagctgcgtgtgcacacgcttgataaatatttcctattttgacatgcagtgggacaaggcttaattacctataactataaaatagggataataggctgggcgtggtggctcatgcctgtaatcccagcactttgggaggctgaggcaggcagatcacttgaggtcaggagttcgagaccagcccggccaacatggtgaaaccctgtctttactaaaaatacaaaaaaattagctgggcatggtggtggacacctgtaatcccagatacttgggaggctgaggtaggagaatcgcctgaacctgggaggcagaggttgcagtgaaccgagattgtgccatcgtactcctgcttgggcgacagagtgagactccctcccccccccccaaaaaaagggataataatggtacttccctcactgagcagttctaaggactaagttagatgttaagtgcttacaacagtgtctggatatagaaagtaccctagaagtgtgtgttaggtaaggacacacaaaactcctgcggcagcctaccgtcccaaacagcagcctatgggtgctctatccaagtacccacaagttaagagatagccccttcccctccacgcccccgcaccccagtcagccccaggcctaccttgcgtttcctcttggattttggcaaagccttttctgcaggtgtgtccgaggtgtggctgggcggtgcgctctcagagtccttggtggcaggggcgctcaatacccctggctcctggggcaggtgttctgggatcctggacaggagggtcaggtcgattttgacccagagagacctgatctcatcactgtcctttagaggggagagaagttcgttccggccaaaggggaccagtgtgtagaactgctcctccagctccttggcgatgtcactggtggtcctggcgttgatggagcctacaggggccctaggaccactgcccccgttggcagcggcctccttcagcctctgatcattcccggaggaggcagaggcagccacggtctgtgctttggacagagggtactcctcctgctcggactccaggtcggagtccgaggaggaggatgaagatgacgactctgtctcaatgaactccttggatttggggacgatcctgcttagcccccgcgtgcggcgcttctcgcaggtcacggaggagcgcagctccttgcggtggctcgctctgttgttgccacagggcctggttttggtgggctccggggggaccaccacgctcgtccccagcgcgtccgcggccgcgggctcctcgggccggtggcagttggcgccgtccccggctgaggtcctctcggtgcgcctggtgggcttcttgcccgcggacctccgggcaggcgcgggcgcgttctccgcgggcgcacagggcactgcgggtggcggggcggctgcgctcaccgccacggccacggccgcgggcggggacttctgcttcacgcctttactcccaggggccttgttggctgtccttggcctttgctcctccttgcaagtgctcttgatctccttctctctcaggctgggctggcaaacgtcggggactttcccacagtcctggacgtcctctttcaccgggttgtagtactgattgctctctgacccgtggctttcattttggatcagaataggaggcttgtggggattaactttgtttagccatttatccagctgccacttgttagaggatgccggttcagcctgaaagcagaaaaccggtgacaaacaaaacatctttcattacaggctcacttaaaaggggcctggctgtttttatcttgacttacttctctaagtatatgagcagaaaacgaatgggctggaagcaaaaggaaaatggaagcattaagcgtgtgtggcagccccatgtggcactcaggatgcctggatgatgctgtccttaccggcccgtggcactaaatgtccttgcagcacttcctctttggaaaaataaggaaagcattgtgtctcattagaacccatttcctagtacttttgagtgttagtataaatttttttatataattatatgtacatatgtaaacttgaaattccccaaaactcagagaattgtttagaggccctgagcataaatcacttgtttttttggtgagacttaaaactttggggagatctgaagggggactaagtggaacctacaatcccaaacaattaacacatgatttatgtgttgaaggcaggtaggctgtagtaatttggtagtaggagcaatgaccttgggaagatggcttgttttgcatatagaactatttcagaggtatttgtgcatctttggcagcctgactgggtcagtctatcctcaacctgcttccatcacactttgctagaaatatttcaaacatggaggtgagatggaacactttcctgcaagcaggtttgctaacttagagcaactcatgaaagtcattggttttgaactgtggccccacaggttggctctgtggttgagggtggggggatggctagggaatgccctgaaatggatgggaaatgtgtagatgcattttgtttctagaagaggtctgtacttttcagttgtgtctctaagaatctatgtctcagaagcaaaaaaaaattaaggaccaatccaataatttcacagggagtaaatgctgatgtctaaaaagtcaatttatccagcattatgataattaagagaaaacaggtgtattgagaagaatagaattttagccagagtattttcaatttgtgactctaagtgaaatggggaaagtattttggctaaggtgatgtgttttttcttccctatggccttccacctttcgaattcgtggcatccattgtttcagaggagaccagataccaggctagagtaagaagacactgcttagctccatacttcaagcttgatcagttcaagtctagagcaaattgggtctgttgccagagaaaaaatggtttaacacaataaataaaaataataaagtttaataaaattttaataaaaataataaatacatttaaataataaaatttgaaaaggttcctttgaagtatcaaggtttgtttttcaacagtgaggcctgtattaagagcagaactcagggctcttggcctcaccccaggcactgaggatttcagaaggggaataagagggctgtatcatagaagcaggggccttggctgagtccgggcacaactcagggaaatgggaagcctctgatgggccagaacgggttggggccaagaggaattggccacagagcgtggggatcaggcaaccagagctatgacagggaccatggacatcttgctggttgccccaaaccagatgggaccaactgccctttggggcagactggcacagggtgtctggtgacttggagaagcaagaaaatttcagtgaaggccagaatgaggatgaaggccccttccctgggctgtgaggatgcggaagcccatcctggagtgcaggtggggaaggggggaccccctggccccgacacagattctggtctttgacgtgacatttttctttgcttgttttcatggccaccaacggaaccggggcaccagagaaatatgcaaatgagtagaaagacagatggtttttgtacctctgagttctgcgtaaatcatgacctcgctttatttggcttctccagagaaagggaacacgggaaacctatggaacatgcccagtgcatgtggcggtggcagatgccctcccatggtcagagaaagcaggacagtgggacacggaacagcttctcggccaagggggatccctcacctcccctgagattagctgagagtgcctgaaaactaatttggtggcaaaaatcaatggcttctaattttgtctccctcaacccccatttctctcatcaagtcagtgccttcgcctgtgcctcagcttccctagacaaatgggacacagtaaacaggaatggatgctgaaggggcctcttgcagaaagggtgcacatattggaagagggcacacacacacacggcagaacacacccctcacactggccccgccactgcgtttcacactagttctccctcactgctaccatccggagccttctatagcccacatctcatatgtgagagaagtctgtttgtagccaaaacacagctgcacacaggaaaattcacactgaaacttcctagcaggagcattaacagaagggcagaatttaatacatttagtacaggcccactgcctggtatgctttagggtcattttttctgcacttcacagctgaggaaatcagtttgaagtacccactttcaacacatcactaaatcatacttttttttccctcaaggatctacaataacctcctattgcctctcaaacaaaatccaaatttctaaggggggcgtttaagggcgtccattatctcgtaatcatctttcattgtcagaatacctacagtttaactcccacttcatgtgtattatctcatttaatctttacagataagaaaggttatcatccctaacttgtagatgaggctcagagaggctaagggacatacccagagctgcacagctaccgggctctacggagactaactttgtactcatctaggtttaaagaccaattgtctccacggctgcatcactgtgtctcccactgtttggcatagcctcgtgaaagggggaccgcattcctttgagaaatgtcagtcttcaacttaaaatgacagaattagatctgaattttggagaaaacaccaagaacactccaaacagtacttgttgccctctgttatactcaattgcgttgtcttttgatgttcgtatttgtttcatgtgtatatatgtcttgtgtcttcaaaaaagccaaatgcttctttcaggcaagggccaggtctctgtttctttagtatcccttgcagcatctatactaggtcagggaggcagattgccacatctctcctcctaataagaacaactcacaatgaggtgtcactcaaattgtaccatttattcctttattatcatcattttccccccgacaacctcacaggttaggcagagcatgattatctgccattctggaaatgaggcaattgtggccaaggaagctgcaaggatacagagtttagtggcagtgaggaggggaacctcaggctgcagacgccaggccactggcatgcggctggccacagtccgcctcctgagccgtccatccggggtttctgcccaaggttctggtttgtttgctggctcactgctttatattttcagccatgactctcctccctaattgatcttccctctgactcacgcaccagctctccatcatgcactctggtccctgcttcatctaaatccttcaagtacccgctgccatggacctcgtaggcacctaataaatgagaagcttgttgagtcagcgagcaacttgaatcacatttctgttgatttttaagaacgatctagggcagcattttccaaaatgtgcttttagctcatctatcccatgaaggagggtttccagagtcagatcaatctgggaaatgccacaatggaaaacacagtacacccgagcaatagtaagggttgcgtgatgattcgataggtaaagaggtggaatcaacctattttgtcccagatctctttaacattaggtatccaggcttttttattttatttttttcctccacgtaatatatattgtacaacaaaggccgagtgagttccgtgtgtggggtcaacatgttagctgagtgcaaaagcaacttctcctgcaaagctctggtataagaggctgtacagtgcctggaaagcagattagactccggtgagaaaaagttgtctgagaccaatgaagcccacatcatgccacagagagggcccctccatgctacgcgggaacatggcattaccatactacagtgatttacgtgaaacaaattggctctcaacacacacagccagaaagaacatctcctacgcaacccagctgagcccagtgggttttctgagtgctgggacatggtggggagaatacagggcgcctcctacgcccatagcaggatgttacagcaggggagtgaggaacagaggcgttctgcttcaaagcagcacaaactggtctgagcagcggaatgtgaggtgcatggctatgaagagcctgactgtcatgtggggttcaggaaaaggagtcttacagctctctgtaaggtgacctgggccagctccgccagaccaggcagcacagctgtggaggacacacagggtgatgttacttcctgcctttgccatttgcagtctgcaaactcattttctttctaaagggtgtgtgtgtctgtattatccttaggaaaagtgttaaaagaactttacttttattccaacaaatacatttctttcctgcagaaagaacgaacgtgcagcctggctaacacatcacctgctgcttctgcagtcctctgtgtagggaagccaggaatccaaaaccacacatagcatcaggtgacttaaacttttaggactgactcctttaggaggctcttgcccctctccttagcgaggggcctctgatagctgctggaagaaatgacaagagcctcctttcatcacccaggagttcaagtctttgtaattatctcagtgacatttagaaagcatttgcttaaagcactttataactgtactgctctttttttctttctttctttttctttgagacggagtctcgctctgtcacccaggctggagtacagtggtgtgatcttggctcactgcaacctccgcctccagggttcaagcgattctcctgcctcaggctcctgaggagccgggattacaggcgcccaccaccacacccagctaatttttgtatttttagtagacacatggttttaccatgttggtcaggctggtcttgaactcctgacctcatgatccacctgttcagcctcccaaagtgctgggattacaggcatgagccactgcgcccggccaactgtactggtcttaaatgaggttccagccaacacaggagctctaggacctacatttcaggatgaaaataagcctgaacattcatgaatttaacctgcaaagccacaaggaggagcctggatggatgatcttcacagacacaaacagtttttggatatcctcactgcctgccctgtccttgcactgtccctgggacgcagttatttcttataactaaatattccagaatttctccacaaagtatagcataaagcaggctttaaagaagcctgcttaactcttctactttatttaactcctgtatttttttcattttgaattatccccattagaatgtcagctctatgaagatagggacattttttgtcatataattgtgtattccagggccaagtactgtgtgactgatgctcagtaaatatttgttgaatgaattctgaatgagtaaatgaatcaatgaatgagtaaatgaaattatgctgaaggaataataatttagtttctgggaaaagccagggttatgttaccataaggctttcataggttaatgttgctaagagccttcccctcatacagagattgatagatggataaatagatggatagatacagatggacagatggagaggcagagactgaacctcatgggaaggagagcgtggagagatggcttggttcaggatgaatggagagtcctgagccagggcagaaaggtgctgaggagaaaatgaggagtgtggggaaacaaaatgtccctgatttcacagtgctcctgcaaaaagctttagcctcctgaaagaagtagggaggggaaaaacctgaaggaactgaagagccactctgtgaacctgagatggaaccactgctttcaggtgtgataacatccaaggcaccgctataaaagctggacacggggatgctgatcgggcccattaaggtgctcccctcccactgagatggtttgtagaagtgggtttagttccatttcagagcctatttaggaatatggcccccccaaatggtacagagggctgtaagtaaaaaattaaacctgacaatcattagtcatgtcaaatgtttacgcactcaagaagaaactctattttactccttgtttagaaattagagtctacccttagagctctgcagcctggggaagtttctctcagccctctcccaagaatcttcatgctctgaattactatttaattttccccttcctactttaaagtagaaacagcaatggtttttattggtaccttctaatgtttttataggaggcacctaaatcttccacatagatactcatcacagctataaaaggtttcatcatttttttagggtgatgctaatttttctttttctattttcacaaagaaaacacagttaagaaggttttattaatatttatagcccttcttcttctgatccgtgacaaaccgcaaaaaggtaagaatctgaccatgtccaacccataaaacccctttccctgtgatttatgggtggtcacacttcccaggcggtgagtggctctgtccagcgactgccctggctgaccccaagggagacctgagccataggttatttcctgtcagtgatgtttatagcatacttggaaatttctggaagtcaagagagaatctgggggcaatgaaagttgatgtttctgtacttcaaaggaacctgtgaaattaggagactgtgaggagggggaaaatgtggagcccgaagcccatagcctcctccttcccagcacctggcttggggtctgcaggagggaggagacctgcagcagtgtgacagtgacaatgcccggacttgctatcctcatagagacagaagtgggcagaggagaggcctgagccaggcagcgcttacctcggggctggagaagtgggggggcttgctgccctcactctcgctggagctgctctcggtctccgagtcagatccggagctgctctctgagtcgctggaggagctgctgctgccgctgctgctgctgctgctgctgcccttgctggaaggcaccgaggttctgcagttgggctgctggaccacggcgctgccagcccgcgaggcccccgggaagcagagggaaggaaagccaagtgagcaaacaggaaaacaccaccaagctgtcatgcaccctaaagagggaggaggcacgcagcctacacatctgtcaaccatgacctggaactcaaagagcaggcatcgaggtcaaagtcatcctaaaggttaaagcaactcatatacagaaataaaattgggggtgaagttggtgccccttggtagtcgggcactggttattcgtgtggccattttggaagggaaggtggtataacatccaaatggctgtttccattttgctgctgttctgggaatggcttttcaaatgcatccccaaatccaatcatctacaaaaatgcaaggaaatccaaaaagcttgaactattttgcaaagcatgaaaatgactgctttatttttgccctagaggaaaatgcagcatgatggcagggattaggcagagggctgtcaggaagggcacggcgttctgctctgagctttcatgacctgctggaaggttccagagacgaagggactgtccaagttcatgtcttgcttcctcccttttcccacctgtagttgagtgctgtagcgattacaggtgctgggatgttgttataaactgtaaccttcctttgagccctttcctagagaactgaagatccctcactgacacactttcgtatattccggactttaaaattcaatcccggtgctgtgacttataggaactgcatttcacatttatacttgatgtttatatccatgctgaaatttgccagaaagtcattacatactcaaagataacaagaaaaattgactgatgctttccgatagtaattaattaaccataaaaattcaaatagcatacatccacccagaaagtgtttgagcagaaaagaaaatttcagtactcacataatattcaacatcttcaaagtcctttattaacaaaattgaaacacaccatactgtgttcttttgaggtcaagctctaaataccaaaaatgccggtcactcttgtatgttgagtcagcaaactgcttccaactgtgaccagtgcttctataggaccgagcatcaatgaaggccaggggccagggagcttgtgggggtttacggtctcaagtgcaaagcagcctggacatggtaaaggacttgtttcacccatcccttaaatctttgatacgtgctttgcccaaagaggactttcataaatcctgggtatgggggtggggatggaggtaatactcattggagctttgtttctataaaaaccaccagacaagaaactgtcttgcaggggatctaaaaataaaagcacctcttggaacggcagggttaggggaaccagagtgtgaacataactttccctagtggggttttcatttcttccaccaatgtcacggtccacactgattgtctgacaaaattcttcagcagcagacaacatctgcacatttatgccttgcctgagctgcagcgatttcttttccagcctgttatttgtgtctagaattgagtgaggaatcctggatcttaagacagagtagggcaaggcacagttagagctcaggggctgtaatatttctttccttccttatgaacaaaaatctgtctttcctgttggctgaatcgagatggttactgtcattggaatcataaaaaaaggacgattgaattctgactgaacatgaacatctgggatccatgttaatagtctgtagaacctgacagaaacaagcaatggggaaaggattccctatttaataaacggtgctgggagaactggctagccatatgcagaagactgaaactggaccccttccttacaccatatacaaaaatcgactcaagatagattatagacttaaatttacaaactaaaactataaaacccttggaagacaacctaggcaataccattcaggacatatgaatgggcaaagatttcacgacaaagacgtcaaaagcaattgcaacaaaagcaaaaattgacaagtgacatctaattaagctaaagagcttctgcacagcaaaagaaactatcaacagagtaaacagacaacctaaagaataggagaaaatttttgcaaactatgcatttgacaaagctctaatatccagtgtttataaggaacttaaacaaatttacaagaaaaaacaatcccattaaaaagtgggaaaaggacataaacaaacacttcaaaagaagacatacatgtggccaaaaagcatatagaaaaaagctcaatatcactgctcatcagagaaatgcaaatcaaaaccacactgagataccatctcacaccagtcagactggctattacgtaaaaatccaaaaataataggtgttggcgaggttgtggagaaaaaggaacccttatacactggtagaagtgtaaattagttcaaccattgtggaagacagtgtggcgattcctcaaagacctaaagatagaaatatcactcaacccagcaatcccattactgggtatatacccaaaggaatatagatcactctatcataaagacacatgcacgcgtatgttcactgcaacactattcacaacagcaaaaacacagaattaactcaaatgcccatcgatgacagactggataaagaaaatgtggtacacatataccatgaaatacaatgcaaccatttaaaaaaaaaagattatgtcctttgcagggacatgaatggagctggaggccattatctttaccaaactaatgcaggaagagaaaaccaaatgccacgtgttctcacttataagtgggagctaaatgatgagaacacatggacactgagaagggaaccacacacactggggcctattggagggtggaggatgggaggaggcagagggtcaggaaaaataactaatgggtacaggcttaatatctgagtgatgaaataatctgtacaacaaacccccatgacacacgtttacctatggaacaaacctgcacatcctgcacaggtgccccttaacttaaaaaaatcgttttttggtagatcccaaaacactcaaaacactggggggaaacactcaaaaataaaaaagcaaaacaacacatggctcaaaagcttccttgttagaaggatggggttgggggacatagatgtggaggaaagatatgtgtttctctgtcaccctctggagtgacatctgccaaagattagcaaatgaagatgaataaagaacattctgattggtgatcaaagccattggacatcatagaaaaccaatcagtatattctatctgctttcactcaacaaaaaacatgcgatgctggttctgtgtgctctgggctttgcgtgtacagcagaggcagcaaggtgtgtgggattccttgtggcttgcaccacaaagtgactgtcttttgaaaactggcactttaatttctgggaaagcgcccattcaacagttaccatgctgcctgcctttaatggctgcggtcctgaagtgatgaggcacactagcccaaggaggcagcatctccgatctgaattacattggcagaaaaaccttatacgttaatgttttcctttcttaaattacgaaattcacttaaaatgacagttttactggcctaactattatttgtttttaaaacagctgagagagccaagagtttaggtttttcttcatactttacttgtaagggttgtgaaatttatgatgtctggattaaatatattcatgtttcaatggtcccggtagagcatgcataatatccagaaacaatcatagcaaagatgggggcagactttcctggaagggcgctggtagctccagttgtgggatcaagatcactctccccacttccacaaaggcaactcctctaacccatccttgcatggggccttggggtcagctgaccattctggcctcagtgtagtgactgctcccaccacgggtgcttgcagctgctttacccatcgtggggcagctgcagcagtgagggtggcagagccaagatgaagaagccaggaatggcattccctgcagacgagtgctagtgaaaggatggactcggctaagccacaaacacacacatatacatacgtctatagaatttgttgttgcccaggctggagtgcagtagtggtcatagctcactgcagcctcgaactcctgggctcaagcaatcatccctcctcagcctcccaagtagctggaactacaggcatgtaccaccatacccggctaatttttgtatttttttttttataaagacaggatctttctatgttgtctaggctagtcttgaactcctggcttcaagcaatccttccacctcagcctcccaaagtgctgggattacaggtatgagccactgcacccagcctaggctttatatatttaaaattgcaaactgaaaattttggtgtgccaattggttgtcatgtttacataccaaagatgctttaaaaaaattaacttaagcctgggcagcatagtgaaaccctgtctctaccaaaaaaacaaattagctgggtgtgctggcatgtgcctgtggtcccagctactcaggaggattacttgagcctgggaggtcaaggctgcagtaaaccatgattgtgccactgcaccccagtctgggtgacagcaaggccctgtaaaaaaaatatatatattatagtggattttttcctgaaatgataacacggattggttgacatgatgacataggcttggacaatttttagcatgctacctaccaagttcttggacccagtgccatctcatgaacacggtgccatttgacagcagccagaaaacattattgagatcatggaataaaagtctttgtgtcaccaaagctcagcacagtgcctggcacataataagcgttcatgtgtgattactaaatgaaaaagtaaagagaaaaaatccaacactgggttaatgagttttttttttaaaaaagagattgaatctttcgagaaggttataatgtcacttttccaattaaaaaatatttaaaagtacttcaggacgggcgcggtggctcacgtctgtaatcccagcactttgggaagccgaggcgggaggatcacgaagtcagatcaagaccatcctggctaacatggtgaaaccccgtctctactaaaaatacaaaaagttagccagacatggtggcaggcacctgtagtcccagctactcaggaggctgaggcaggagaatggtgtgaacccgggaggcggagcttgcagtgagctgagattgcgccactgcactccagcctgggcgacagagcaagactccgtctcacaaaaaaaaaaaaaaaaaaaaaaaagagtacttcagcaacctttaagacagacttcttcccttctgagaatatttctttaaatgtactcaagtttcatctgctataatttaagcacagttccctcttggatggtttgtttactttttgcattttgacttcatgaaatgtttggctggttttgtgagtggtcagagccaaatacacctttgagaggggtccagctttctctaaatgatctgcttggtgtgtttcttcctatggctgtgatgacaccttccttttggaatctggccttggctaagtctgaatgcagatcataaaagaaaagatctggaggctgggtgcagtggctcacgcctgtaatcccagcactttgggaggctgaggcaggcagatcacaaggtcaagagtttgagaccagcccggccaacatagtaaaaccccgtctctactaaaaatacaaaaaattagctgggtgtggtggtgggcgcctataatcccagcaactcgggaggctgaggcaggagaattgcttgaacctgggaggcggaggttacagtgagccgagattgtgccactgcactccagcctgggcgacagtgtgagactctgtctcaaaaaaaaaaaaaagacctggaaccaaaatgacaaaatcttggatctcacagtcaagggtgctcctgcctgccaagtgtattgtggggcctgaatacatatccaaaattgtccacacacttttaactgacaagtaacttggagagaggctctctgcctggttgttgctgtgtggacagctgtggtgcccacatcgcaccacacatgctgtgggcactccactgggattgactgaataacaatgtttgctcctcctcttcaacactctttgagaacacatgcttgatatccaaaccataatcagtgtcctggcaacagtattcctttattaatagcatcactattgatattaattcatctaaaaccataccacatggtaagtgaaaatggtaaatgcgggattgaagaggtttgctattgctaagaattgtcgtctaaaaaaaaacccaactggcaggactgttgcttctatcctgaaatgtaattgtttgttctgcaacacttccaagaatgatttctctatacaacttggcttttgaagctcttcagggtctggtctcaatcagatttccagcttcacctcaatgggtctatccctaaaccttggcaataatacatttctcagcgtctggacaggctgggtctgtttccagcagggtgcccttgcatatgatattttctgtgccagaaagtcctttctccctttttcctttgagttactgttacctcctactccctctgcaggactgagtggctatgtttccctactctgtaaaggttttcccagctcccctaggcatcaatgatgtttcctcctctgagtccctctagcacactgcccacttctctattgcagcccttaccacgttaaggattggaatcatctaatttatccatgcaatgtatttttttctgttcccttgggaatatgcaggagttcttaaaactggtaactttagaatgctatcatttacatacgtatcaggttgaaaattgagaacccacgggggccacgcaagtagcatccatgagtgaagtgttcaggtataagcaaaacaaatgtgtaacattataaatggcagtagaccctcagctccccagccgaggggaaggaaccaaactggagaatcccactaggtcgaatgctgcttctccaggctagcctatctctgtacctggaaacaagagctcattattaccaaatcttttgattttttttcacatgaagccccaaatccttatgtttatatcaaatctcctgattttaaaatgctggtaactaatttgaaaagttttaacaatgaaaagtttcattgtattttagcaatgaaacacatttggtaaagaaaacacacgtgggtaagaagaggcctgtggggcaccattctgagacctctgatctatgtcccattattacatgttttgagatggctcaatataaaatagaaaaatatagagaccacaaccagaagaagttttacccactcaggaatttagactagcagggccagggacaaacaaggggtgaaccaaacactctcacttcctcagcccacctttttttttcttaaagtgaaagcaagtttattaagaaagtaaaggaataaaagaatggctactccatagacagagcagttaccaaacaccattttgtatttttttctttatttttttaaccttaggatttgtttttttaattttttatttccataggtttttgggggggaggggaataggtggcatttggttacatgagtaagctctttagcattgatttatgagattttggtgcacccatcaccctagcagtatgtactgagcccaatttgtagtctttgatccctcactcccctcccacctttcccccaaatccccaaagtccattgtatcattcttatgcctttgcatcctcacagcttagctcccacttaggagtgagaacacacgacgcttgattttccattcctgagtcacttcacttagaataatagtctccagacccatccaggttgctgcaaatgccattaattcattcgttttcatgactgaatagtattccatggtatatatatacaccacattttctttatccacttgttgattgatggatcagtccacttatttaaaaaattctattttgaaataaatacagattcactggaagttgcaagaaaaatagtacagagatcgttcttgtgcccctcacccagttactcccaaggttaaatcttatgtaactacagtacaataccaaaaccagaaaactgacaatggcacaatatacagttccttgtaattttatcacatgtatagattgtcaggcctctgagcccaagcctgcatgtatacatctagatggcctgaggcaataaaaaactgcaaaagaagtgaaacagccagctcctgtcttaactgattgaccaaccttacaacattccatgatgacttgttcctgccctgccccaactgaccgatcgacctcgtgacattcttcttctggacaacgagttccatcatctccccaccatgcaccttgtgacccctcctctgctgagaatagataaccacctttaactgtaactttccactgcttaccagccttgttgctcacacaaagcctgttggtggtctcttcacacggacgcgcttgacatagattcatgtaaccaccaccacgattaaaatgtagaactgtcccatcaccataaagatctccctcatgacacccttttaggagcattcacgccgacctctgccctctaccattcctaatctctggtgaccactcatctgttttccgtctctaaaatgctgtcattttgagaatgttatagaaacagaatcacatagttatgtgttcttttttaaactaaattattgagatacaatttattcatagtaagtgtccttttgagatgggccttttttcagtcgacacaatgtcatgagagccatccatgatttttaatatatccatagcttgtttctttttattgccgggtaggattccatggtacagacctttaaaggttcctctgttttttaaccattcacccaatgagggacattctggctgcttccagttttggactgttaagaataaggctgatatgaatatttctgtataggtttttatgtggatgtaaacgtccatttctctgggacactgcttccgggactttcaaatttgtcttttgtcttcagaattggactctgatgagtctgggtggggatttctttgagttcaccttgtttgggatttgttagcttcttgagtctgtaggtttatgtcttttgtaaaatttggcatttttaaagccattatgagtatgaatactttctggataatttccagcctcactctttctcttgtccttctggaactctgatgacacccacgtaagatcttttcttacagtcctgcaggtccctggggctctgtccttctctaccccccagtctgtttattctctgttgttcctatcaggcaatttctcttgttccatcttcaagttcagtaattcttccctctgttctcttcattctgcggttgagctcatccattgagtttttcaaattttggttatggaatttttcagttataaaatttctatttgccttttccttgtattttctgtattattgtggtgagaccccccctactttttcagttgtctcaagcttgtttttaattgcttactgaagcattttatgatggctgctttaaaatgcttgtcagataattacaacatctgtgttggtctcagtattagcatctgtggattgtcttttctcattcaagttgagattttccaggttcttggtatgatgagtgattttctattgtattctgagcgtttttggtattataataccttgatttttaaaaattattgcttgtttttgcaggcctccactaatgcgatgttggcaggggaagggagggttgtctccctacagttgtgcaaaggtagaagtttaagctccccactcaggctttgctgatggagagggggccacagttttttttccccccacggtgtttgtctggaatagggtggttattgtctacaagtttcccacggtggctcacacctgtaatcccaacacactggggaggccgaggctggtggatcacttgaggtcaggagttcgagagcagcctggccaacatggtaaaaccccatctctactaaaaatacaaaaattagctgggtgtggtggcgcgcgcctgtaatcccagctacttggaaggctgaggcaggagaatcgcttgaacatgaaaggcagaggttgcagtgagctgaggttgcgttactgcactccagcctgggcgacagagtgagatatcatctcaaaaaaaaaaaaatttattcttgctaggatatgaatttcctgaccctttcactacagagaactggctttcctgtggcttccgtctgtgcctactgccaggttgccagcttctccagcatccactctgtgctatacaaggaaaaaaggaaacctggggaagtcaccaccatgtcttttcctcaggcccgaaggcccaagctgatttgccttctccccgcctttcagccttattatgtttgttttatatgtaacatccatggagtttagctgtacttagcaggaggaagaggaaaaagtgcattaacatcttgtcccagaacaggcaaccacccacttggtatttagcaagtagaaaggaaccctctctcaatacttccaacctccagctctagttaattatctcaaaagctgacgaatgaaacaattacaaaagtctctgctatagttcctgcccattttatcacctagtcaaattaggcattaattcattcatttaaaaactgctattatgagaattaagctcagattttacaagggtgtataccaaacctgaaaaggacatgttaccaagaatgtacacagcctcgtgagaaaaatgactcaaatgaaatgaggctgtaaaaatgttaaggatagaaagttgagtgctttaaatgttatgttcatagtgaaacattctctcagtatatctgtgaggtaatgggctttccaggattccagttagctggggacagagaaatggattggaatatctaagtgttgactttgctttttccctgggagaggatagggttttgctgatgctgggttttgctcaagattgagttagagcctcttggggcacctggaatctgagctggtgcacggcacacctgttccagctctgtgggagcacctctgcctcagtcattccgtgaccttgcctaaataagccgaggacctcatctaaactcacagggtgtaagtttgtggtctttccctgccagtgtgtgggctacaaagcagcatgatcacagttatgtaaaaatatacacacagaggaaaaaaatgctggaaggatattcaaatgttaactgtggatatttttggatggtggaattatggggattaaatggtttttgaacttttctgtattttcaaaattctcattttcttttcaccaataaaacacatgacaccattttcaagtctacgtgattgtgggaaatgactattcatgtattactgaatttagcttgctcgcattttatttaggagtttagggggttgatattcacaggggaacttaatatttacatttacatattttacattttgggggagatttttggcaggttttgtatcatgatggttttagcttaaaagtataaattggatagtgttttaccttttcatagtgttctgggaaacgttaagtaatataaaagttatctgttccttgaaagtttaaaataatttgtcaccaataaaaccatctaatctcagaaccttttagaatggcaattctttgatatctttcacaatttattatttggttattggccattaattcttttgtcaatttttgaatttttttcccaaaagatcctatttaatttatattttcaattttattaccacaaaagttatataatgttctcttataataaaagcatggtatctattatattacttctttttaaatttttcctctttcttcattatatttgccaaaagttttctattttcaaagaaacagcttttgattgatataccataataactctagtattttctggctttgctgctacattttcatgttcatttataatacttttacaaacttcttgtgttgaatgcttgtttcagctatgtttactcttccttaataatagcagcctttgcgactatcattctgcctctgagtatacccgtggttgcaggcgatcatccttgttatgttctgtttttattttccttactttctaaatagatcattgaagtagtttttaagtcttgtttgatcaaatagtcatttagaagaatgcttttcaatacctgatgacatttcagtgggataaacattacacttaggtccaaaaataaacaggatgggaatgtataatagcttagcacatgtggaaacctcagtggtcagcagcttcagcccggggcaggaaccttagagctgttttgagccgatttggaaaaggtgagaggagggacaggcagcacagctcattaactctgaaccaggagtgggatgggagtagagaatggcctggggaagggattaggccataaagaagacttatgcaccactgtgatatcccaaagggccctgaaaccttctattggccgtagggaacaataaaagtcaacagaacctgccacatttagcagaggagaaactcagtaatacaggaggtccataaacttggacataaattaagtctcacatttcactgctgatgctattgtagcatctggaactctttcagttacaaaccaaagaattcaaagatcctcctgaccagcccattaggcatttacacagacatatcagggagtgaggtgctgaggcccaacttccaatttaagaacagtgttgagacacaaggcttgatccccaatttgagataccagagagcacagatgtcaccttgtggggtcctagttacttccataaaatgtcatagatgacaataagccattagttcttaaccaggtgctggatcccgtgctctcttgcttagaggggcgctttggcttggggaatctgttctaacactcgaaacatttcttagtttggaattcctgagtttatagcatcactacctgactactgacatttgctaagaaatacaatttcttttgttcagggttcagccctgcttttggatttatcagcttttctttttcagatgggtgaagaaccttctcttgtagatgaaccaagacaaaaaagctattgcttggagctctgggtcatattgggaaccaagttttactttcagttgaataaagacccacgtgtggccccaccaaagataaaggcatttcacaaataaagaaaaaatacaataatgtacagacattcattggttcccaaatattcctgggcttactgatagtttttcagagtataatgtaataatatatttatttaatactaaaagtccatcagagaacagtttctatacagctgtcttctctggacccagggctttgaatggggcagagccctctagcctgtccttcagatggaagtgttcttggagatctgtacatgtcactgggcagcatggaaatggctgccgatctttttatgtacgaacatgaattaggctgggagtccagatggtagagggccctggaggacgccaggcttgtccgctgtaaaaggcttctctgaaagccctgtgttggcttggccaggtcccctctgcaccacacagcttggcaagaccagtttgcagctgcacttcccgcctgtcctgggcactgtttgagagactgtgacaagcggcagctgccttctggtgatacaactcgcctccccactttcaggcgggtggtaccactagagacactgagttgaaaagcccttcttggcccagagagaacctcaagcagggaattcaacatccttcttcgacaactgggatgggagctgccatgtggcctgggcccagccatgagaaagctgagaacatccacttggacaactcctcccctggcagagggagctgaaagcgtggatggagtgactgccatctggtgggcgtgtgggagccagggtgcatgggatgggaggcgctgcctctttggaggctgagatggctggctggcgggtgggatggccgtgccaggggttgggggccattgccctccagctgccaagagtgagcaggctgccccagatgagcgaataacctcagcagtgtttcatctaacctgcttgcaggacacagcttccatatgcttccaacttcctctgtgtgctctccctgccactgcagctgctggatatgggcagggaagctcctactcgatggcttttcaggcaccaggtctatggggaaatgctgggagattctgggctaccagaattgcctgatactctgagcttctttctagccctaatctcagaggttagattcccagggactgcttatagaggtgaaatcatgttgagggcacctctgtaaacccatctgcttcctacctcaatcctggaagagagaggctctactgtgaggaacacctcttttaccccaagcaatgggagcgttttaaggcaatgtaacccattagagatcctgccacccatgcacttatttgtaatagtccttccatttattcatatatattttcagttcgaggaggccttttggatagtgcggcctcaaacttccatcctcatggaaactccataatccatatggcagtaacactctaccagagctctttgactttttttttttaaaaacatctttattaagataaaatttacataccacccctttaaagtatataattcaatgtattttataatcttcataggattgtacaactatcaccatgatctaattttaaaacattttttatcctcatttatcctccttaaaagaaaacagcactttgggaggctgaggcaggtggatcacctgagatcaggagtttgagactagcctgaccaatatggtgaaaccctgtctctactaaaaatacaaaaaaattagctgggtgtggtggtgtgcacctgtagtcccagctactcgggaggctgagacaggagaatcgcttgaacccaggaggtggaggttgcagtgagccgagatcgcgccactgcactccagcctgggtgacagagtgagactgtctcaaaaaaaaagaaaagaaactgtgtacatcagcagtcaattcccattcttcccactccaagctccccttgcccccagccctaagcaagcactaatctccttcctgtagctataaatttgcctattctagacatttcatagacatggaatgatgtaagtatgtggtcttctgtgactgcttctttcacttagtgtaatgttttcaagggtcatctatactgtagcgtgtatcagcactttgctgcttttcctggttgaataatattccattgtatgaatataccacattttgcttatcctttcattagctgatggacgtcggattgtttccattttgggctactatggataatgccactatgagcattcatgtctaagttttgtgcgaacatacgttttcatttctcttgggtatatacataaaagaggaattgctgggtcctttgttaactctaagtttaatcttttgagaactgcaagactattttccaaagcagttgcaccactttgcattcccaccaggagtgcatggggttctaacttctccacatgcttgtcggcaactgttattgtccatctttttcattctgcccatcatagtgggcgtgaagtggtgtctcactgtggttttgatttggatttccccagaggaaaatgatgttgagtatcttttcatgtgcttgttagccatttgcatattttctttggagaatgtgtattcaaatcctttggccttttaaaaacttataattgagttatattaattttctatatattctggatacaagttgtttatctgatatacattgtgcaatgtatatcagtatatatctctgtctgtggtttgtgtttttacttccttgatggtatcatttgctacaacacaaacatttctaattttgcggtagttcaggtaacctgtatttttcttttgtcacttgtccttacttgacttcgcttaatagtaacagatgtttaaatatataggattctttaactgttttcaaggcattttcttttcaagtcccacctctgagcctcacaacaaaccaaaggagtagaaaagtcagctacagttatgtctacagaaggcagagcagaggggtccagtgactcactctaggttgcatatcaggttagtggaggagagaggttgaagcccagatctcgggctcctaatactaccctgtgttctctcaggagtgaaactttcccaacaagtggggataaattaccaggcttctggtcccatttggacacatcaggtcattttgccccgtgaggcaggatggtgcatagtcagacagacccaggtggacgttttactgcctctgctcgctggctatatgacctttgggaagttatttaccctctctgagccttggctacctcgttgacatttaaaggggtaacaaaagtgacaacctcatagtgttgctaggtggtttagatgagaaaatgctcataacattctttttttttttttttttttttttttttttgagacagagtcttgctctgtcacccaggctggagtacagtggcgctatcttggctcactgcaaactccgcctcctgggttcatatgattctccttcctcagcttcctgagtagctgggattacagacactcgccatcatacccagctaatttttgtatttttagtaaagacggagttttgccatgttggccaggctggtctcaaactcctgacctcaggtgatctgcctgccttggcctcccaaagtgctgggatcacaggtgtgagccaccgcacccagcctcataacattcttaacatagtgcctagcacatagcaaatgctcaattaatagttaatattattctttaatttttattaactgtaatgcttcttccaacaaagtagcctaaccagtaagaattcttccagtttacctgcattattaactcacattacccatctggtcattttgcagaattataaatgttttctcaggaaggaattgaagagatcagctagtccaactccccagaaaacggaagtggtgtgtacaagattgcacagcaagtgagttttctaacacgacctctcagaagtctcctcttttgtttccataaacctggctgcttcagtgcaaagctacagatagctctgatcgattcattcattcattcattcattcattcattcattcagagacaggggcttgctatgttggccagggttgtctagaactcctggcctcaaacagttctcccagcttggcctcccaaaatgctcggattacacgtgtgagttaccatgcccggcccagacagctctgattttgaacaaggtcaaaggaagctcccaagagagactgcaaggacccagagagatggcagtgcccagatcttagtctggaatcacatttggctcctgaaaaccctctttctaacccagtctctgtctgaacaaaccaattccatttctctcctgtgtttaaagcaaataaagtgagctctgaatgtcagcagcatgtggtgtttaatttgcatctcaccaaggaatacaagacttaaggatgatgagcgaaaaagatttttatggaaaccaaattacagcatctgagacacaggcttgtggccatatcagctcaagctgtgatcttgttagctgtcataaaccaagctgggtttgttccctgggtgaggacactcagggcaaatgtgtaaaatattactcaggtgtttctgcagggagtgctgttcatccttttcaaaggctgcaccacagagcacagctgatagactgtgtctggtgacagggaacagggaccacaattaaaatgagtgaaaacacagtaagaacatgcatgtctcgccatcagaagcccctaaggaggggcgtgcccgggattgggtaattctgaggctcaggggccttaccaaggacttgggctctgtctgtctttccttactgacacccttggcttgtctttaggtggattcgcctcactcctctgatggctgctgcgattctcacacacagatgacagtgtccagagaaagggatattactgccctgtgtcccttgctaagtagatcacccctcactggcttgaatgtcaccacacgcccatgactaagccagttccacagcaagggtaataaggcaacaaatgctagcttaggccaattaacagtcaccccttaggatggaggacgaccaacctcccctgaagaccctggccactcagagtagagtgacccaaacgggttctctgtgaggaagtgatggatgactgctgagcaggcaatcaatggtgtctccctcatgcagaaggcctgctccagtaatgggatcctgggtattccagacaaaccagattagctagacatctgccccagaccaacaggctggcttggtgggtcatcccaactgagactccgggagagaggcattgggcctaggaacctgcacaccagggctctagtcacagctgtgctgataaccccactgtgggtctcagtgacccacatgaagagatgggcttggactagatgatttctgtggtccgtcacttctaatacccttcgataaatgtatacttaattaaaaagaaaaaaacaggccaggtctggtgactcacacctgtattcccagcactttgcgaggccagggtgggaggatcacttggggccaggagttcgagaccagaatgggcaacatagtgagacccctgtttctgcaaaaccaaaaaaatttgccaggggtggtggtgcacacctgtagtcctaattactcggaggctgaggtggcaggatcacttgagccaaaggagttagaggtttcactgagctatgattgtactactgcattccagcctgagtgacacagtgaggacctgtctccaaaaacaaacaaaaatccccaaagaccctctgaaactttggatatttgtcctgtccaaatcacataatctgagctgcattgttggaggtggggcctagtgggaggtgtttgggtcacgggggaggattgctcatgaatggcttggtgccctcccccaggtaatgagtgagttctcactttattagtttatgcaagagctggctgtttataggagcctggtacctcctcctcttctccctcttcttgtcatgtgacacacctgcttccccttcaccttccaccatgagtgaaagctttctgaggcctcaccagacacagatgctggtgccatgcttccagtactgcctgcagaaccatgagccaaataaatctcttttctttataaattacctggcctcaggtattcctttacagcaatgcaaatagattaacacaccgttttttaaattactatccctagagatgcctaacccgaatttccaactagaagctgtgttaatttctattttaattctttctgttcctcccatttaggctgatgagcaatggcgaggccaagaaaagaccagagaaccctggagccagagtcacagacaattcactcctgctaatcttcagttgactataacaagctgcctggggtttcctccctaaattcgcacacagcattgctgtgtaacagctgagcaagtgacagattcctggctttgctacctctaggagtctagataattctcatcataactaagtctgctatgctgtgctgtgggtagagatttcttaacttgctgtatataaagtggcttcaagggatctgcctgcgacctcgtccacccagagcattttggatttcaggtttaggtgggtgaggatttttctgccatgaagaatggtcggtgctccttgcctgtcactgttgctctgcaaccatatgtgcctggtactgttctgagtgtggtggggacagaaggcacaaggttaatcatgtccttatagttggaggacctagaataatgtttaagagaaaacagtgtatgtcaagcgctcaatgcggccataaaattcctagtcctaattcttagttctaagacttgagaggccagggggaagaacgaggagtagagtttccaggcaggaattcttggaggaagtggggcctgaaacactgagcaggatttgctaggaaaagagagaagggggcaagctccaggcaaagcgggtggaataacaggaggctgggatttgcagggcgagttgtgtgggggaagctgaaatagacgcaggccacggggaggaaccatttatccttccttcaattttatagcatccagcaccaggcagcccttctatttagatatgtgggtgataaggaagagagctgaaaaaacagactgggattgcctggtttcctatagggtgtgaagctgaaattctatgagcaaatctatgtaatttaaataagactacaccaactaggacgtgctgagaacaatacaggaccaggggtctccagccccactttggtacagtcactgctggagtggagggaaaatgagtcgagggtgggtgcgttctcctccaaccatggcaactcattctgaatgcactgcagaggctgtgcccccagaggaccctcagggaggtggtcctgatcgaagatggctcccacgtgcagacgctgagaatgagcccaacccatgagaggcaaattaccacgaacacattttattcaagggaaggaatgtcaaagccaggcctttgtttctttaaggtttgctgaaaatagaaaggttgttttatgggcaggctgagcaaagagagagaaggcagagagggagtggtaagaaaaagaagggggaatgaaataaactagaatgtggtcaatataattttatttgctttattattcctgagtatggtgccaataagtctgagttctgcgactcccagctccaccatcacagagaatgtgagcaatctcgcttccagaaatgagctgcccactaaaaggaaaagaatcaccacatcacagaacaggccaataaaactctcagctcagcccagcctgattggatggagtcctcccagcaggttctgaatgacctgtgcatcagtgctggaggacaaggcaggcctgccgggctgcagcccattctttcattgaactcagaccatggggtcagtggatgcagagtcaggccctggctgggcatgggcacaggcaggacgactcagacatgtactggagacagtccttgccgacagggagctcccggtggaagctctggttcatgtctttgatcagaatgactctgcttcaaacaaaggtagccttgcttttttccactgcagaaaagatgagtgagagagttcccaggagacttttggtggtcgaagggagagaggacaggaggaaggtatttagtcagacttcagagcacacctggcagcacgtgcctccgttaactccaaggagcaaaatgcatttgggacctccaattttttttgttgacctctggttctttttttttttttttttttaacttataagataggcctttcctgatgccaaataagggcaatgatcagcttccccattcctggagccaggacctgccacatcatttgcagtgcaaaatgcaaatgagagccccttgttcaaagagcaagataaaagtgccatcctaggcgctcaaaatacaaaggttcctcctttcttctatggtctgtcaattggtcaaggcattttaatttgctacttaatgtcatgcttgctgggcactggaatactcatgcggtgagtgtaggatcccacgggtatctggaggctcgccctgcaatttagcatgtgcaaggagctccccacctctgccagcccaggatgggcgtgtgatgccctggctggggtgagtgaggttgagccaggtatctctgtgtctcatgggcccaaccgacacgggagagaagacaatccccatggggactgcaacctttgaactgggacacatgaggcctctgggttagggtcggggagaggctcgtccccctgcccagccacccactgcatgtgcccttgtgctgtcagcttggggcaaaacgcgggtgccatgtctgggcctgtgagccctgtcctgacctggcatgcacccatgccctcctggggtgctgggtagcagcagttactgtgtagggtggaacaggcaaggccaggtggggccagggcagcaggctggagctggcagctgagagggacccatgggagccaaggctctgagcccaggcagatgctccatcatcccattggacttcacttaaaaaacacgaattcaaagataaagttattaaggatttcaatatgccaaccacagagcattaaactaagtaagaggccatcggcgtacagggccctgggaggctgcacagttcactgctcctgcctggagccaccgggttgcttctacctttgtcttcctctaaaagaaaatgcccaagccacagctacctccaaggttctggggattgttgccttctgaaggcatccagttcctgccaatcatctacccagctacctatctgcttgaattcccctaggtgcttgctagtagaaaggtggaagaaaatttcccagactatctccaggtaaccaaggaggtgacagtttgggaagcttacagaaagctccatggagacagaattttaaataagctggagtcccatgtaattaaaataattttgaattaaaactaccacttcagtaattgcttttatattataatatttactaccattgccattgtgtaacttacctcattagctactgttggagaaaagtcagtcaatgaataattaataggatgtgataaccaagggagtaatggtgtttaaaaacagagcttgaaagaaagtgtcacccacacgcagccccattaataagagcctcgcagtccaatgccacttgcaaggaggtgaggccctggcccgttgcctcctgttattagaggtcaatagaaaaatctcctcagcctcatcacagacgtgcacataggtcaggaattctccttaatggcagcaagaaaaagcttccactttatcaaagcagacagtccttggcacaagtaactcagcaaaaatacaaattagaaatagcacccaaaggccagccaggtgctgaggctgccagccatgcttcagagaaagtggcagtctcgtgtctgccctccggagacgaaggcgggagggcagcaagtgggagctccgccagatgcctccgacctgcatacggctccaccctaccgatttccaaacaggcccagtgcttgcagcaagcaccacacacacttgacacacacaagatacagtctctcgtggaaaatctggaggaacggttgtgcacagctcctgctggaagtgagatgcttattctactgcttggaaagagaggagattcattttcaaggaagctttcttgaagggcgagatagaattttgacttaagttgcatccactgtttgtatatagatggtctttcaagatcctgacattttcttatgcaatttccaagaaagatcaaatacttttagagaatacttttttcttaacggtctttcaatcaaaatatcgtttgcgtagggttgccaggcaaaatacagggcaccccgtgaaatttgaatttcagataaacaatgaaaaatatgcaatattagggacacatttagactacagaattattcattgttcctggatttttacttgctgaatctggcaaccttaagtttgcaatctttcttatccatccaacataaagatgtgtggtgctgagcatgtctggtgctgagcacagagagggcctttcttggaggggttgtgtatggattacttaaggaagataaatgacacctggaaacagcatcaacattaaaccatgtgcaggagatttcctgcttgaaattttgcaaagtgtcttctgggttgtatgacaggatactagacgaaatgacaagcgagaggattaattataattaatcacagaaggaaagtttgagggcctgggaattcatatttcaggttgccaaagctatttaaaaagcaatgtaatacaacagttgtaatggaagaacagtcagaagataaaagtaaagcactgataaaatatcatatgagtctatttcaaagttgcaaaattcaaggttaaaatatttctctttagagcttttgaattagttgaaggggatgaaaggcaagctttatgtaaccacttttccagtgaaataaaacctgtttacatcttggtgactgaaacaccttccagctaatttagaattctcaagtggccacatgaaaagattagaatttctataaaaagaaatgtcccagttgcgttccagttcaggtatagagaacgcagttactgaagggtcttcagttcatctgagctagctgagtgccacccatcggaagctgctgcgtttggacactagaacattagaagatgttattttattcaacagaaccagcttggtagaaatgttggaatttaataaagacaagctctctttgtggtgttttactgaaagaacacagtatctgcaaacctagagtccatttcccaagctcacgtttgttgttgccagttttatttttacactacagaaaaggtagaaaattcctttggaaagtctgcctccctcccttccttccttccttccctcctctctctttccttccttccttcctctttcctcccttccttcctccctcccttcttcctcccttcccttccctcccctccctttctctctcctccctccctctccttcccttccccttccttccttcctccctccctccctctccttctcttccccttccttcccttccctttccccttcctcttccttccttcctccctcccttctcccttctccctcccctcccctcccctctcctttcctttctttcacctttaaggtcaggggtacatgtgcaggtttgttatacaggtaaacttatgtcaccgggtttgatgtgcagattattttgtcacccaggtgttaagcctgttatccattagttattgtttctgactatctccctcctcccagcctccatcaactgacaggccccagtgtctgttgttctcctctatgtgtccatgtgttttcatcgtttagctttcacttgtaagtgagaacatactgtagttagtttcctttcctgtgttcgtttgctaaggataatggattcctgctacatccatgttcctgcaaggaacatgatttgttcttttttatggccgcatagtagcatagtattccatggtgtgtatgtaccatattttctttatccagtccaccactgctgggcatctgggttgattccatgtctctgctattgtgaatagtgctgcaatgaatatatgcatacatgtgtcttataatatgatttatattcctttgggtatatatccagtaatggaattgctgggttgaacagttctgtttttaggtcttcgaggaatcaccagtgttttccacaatggctgaaataaaatttacattcccaccaacagtgtataacgttcctttttctccacaacctcgctaacatctgtttttttttgacttttaaataatagccattctgattggtgtgagatggtatctcagtgtcgttttgatttgcatttctctaatgatcagtgatgttgagctttttttcatatgcttgttggccgcatgtatgtcttcttttgtaaagtgtctgaccatgtcctttgcctactttttaatagggttgtttttttcttgtaaatttgtttaagttccttagaaatgctggatattagagctttgtcagatgcatagtttgcaaaaatgttctcccattatgaaggttgtctgtttactctgttgatggtttcttttgctgtgcagaagctctttagtttaattggatcccatgtgtcaatttttgcttttattgcaattgcttttggcatctttgtcatgaaatctttgcccattcatatgaccagaatattgcctacgttgtcttccagggtttttatagttttggggttttatacttaagtctttaatctatctcgagttgatttttgtaaatggtataaggaaggggtccaatttcaatcttctgcatatggctacccagttttcccagcattatttattaaatagggaatcctttccccattgcttcttttgtcaaagatcagatggttataggtgtatggccttttttctgggctctctattctgttccattggtctatgtgtctgtttttgtaccagtacccatgttgttttggttaccatagccctgtagtatagtttgaagttgggtagtacgatgcctccagctttttgttctttttgcttaggattgccttggctactagggctcttttttggtttcatatgaactttaaaatagtttatttctaattctttgaagaatgtcaatggtagtttaatgggaataacactgaatctgtaaatttctttgggcagtatggccattttcatgacattgattcttcctatccaaaagcataaaatgtttattcatttgtgtcctctctgatttccttgggcagtggtttgtagttctctttgaagaggtccttcacttcccttgttagctgtattcctaggcattttattctttttgtgacaattgtgaatgggagttcatgatttggctctctgcttgcctattgttggtgtataggaatactagtgatttttgcatgttgattttatatcctgagactttgctgaagttgctcatcagcttaagaagcttttgaactgagacaatgggggttttctagatacaggatcgtgtcatctgcaaacaaagataatttgacttcctctcttcctatttgaataccctttctttctttttttttttcttttttcttgagatggagtctcgctctgtcacccatgctggagtgcactggcgtgatcttggctcactgcaactgccacttcctgggttccagagattctcctgcctcagcctcctgagtagctgggattacaggcacgtgccaccatgcttgactgatttttttttttttttgagacagagtcttgttctgttgcctaggctggagtgcaatggcacaatcttggctcgctgcaacctctgcctcccgtgttcaagcgattctcctgcctcagcctcctgactagctgggattacaggcgcgtgccaccatgcccagttaatttttgttatttttagtagagacggggtttcaccatgttggccaggctggtctcaaactcctgacctcaggtgatctacctgcctcagcctcccaaagtgctgggactacaggtgtgagctaccgtgctcagcctaatttttgtatttttagtagagatggggtttcaccatgttggccaggctggtctcaaactcttgacctcaagtgatccacctgcctcggcctcccaaagtgctgggattacaagtgtgagccactgcacccgggccctttatttctcttgcctgactgctctggccagaacttccagtactttgttgaatatgactgccttttgatcagttttgacccagtactgctctcactaggttaatcagccatttcagttaaggcttggccctgagtgacttttgtcagtgaagtctcaggatacaaactcgacatacaaaaatcactagcattcctatataccaacaatagctgagccgagagccacatcaggaatgcaatctcattcacaattgtcacagaagaacaaaatacctaggaatatagctaaccagggaggtgaaggacctctacaatgagaactacaaaacactgctcaaagcaatcagagatgatgcaattcctctgtagacccgattacatagaccctccgactgtactgagtgcagctttccttttttagaacaggcaggtaggatggtgtctcagtcggtttgggctggctataacaaaataccatagactgggaggtttaaacaacagacatttatttctcacaattctgaaatcttcaaatccaagatcaaggtgccagtggatttggtcccatggggaggctcctcgtcccggtgtgcggatggccatcttcttgctgtgtgctcacatgacctctcctttgtgagtggtctggtccctcttattcttcttataagggctctgatcccatgatgggatcctacccttatgacctcacctaaatctaatcacccccaccaaaggccccacctcctaatactatcacattggggattagggcttcattgtgtgaattttaagagaacgtgaacatttagttcataacaggtgctgagatagataagctagtgacaagtaccatgtttcactatagacccccttctgagggctgcctatgggggcaagtgtccccacacctcagaaacactaacatcatggaagggtgagctcaggaagacccacatttcttttacgagctttgccttttctaaggttttagcatcaagacttccaggagatgctcttcatcggaaagctcatggccagaggcaaagataacactggaagcatgatgaggatgcgctgcatgaagcttgcaaagggggaggttaacacggaaatgttaaatactaaccacagtgatggcagtggtgttagaaaacatcagtctacaatagctactgaacacctgtctcagaattaaagacatgactaggatacagtctttactgcttcctcaataaatttacaacaaaaatagagattaggccagagtgggaaggattacagtcccagggagaatcaacaggcatgctttcacatggttggggtacagcaaaggggcccctgccttggtggaaagagaggggccaggtatattagttcattttcacagtgctataaagaaactacctgagagtgagtaatttataaagaaacaaatttaattgactcacagttccacatggctggggaggcctcaggacacttacaatcatggcggaaggtgaaggggaagcaaggcacgtcttacatggtggcaggagagagacagagagtgagcaaagagaaagtgccacccttttaaaaccatcaccttgagtgagaactcactcacaagaacagcatgggggaaaccactcccataatccaatcacctcccaccaggtccctctcttgacatgtggggatgacaattccagatgagatttgggtggtgacacagagccaaaccatatcaccaggcgtgttctgggctcaccttgtagaagaagtgacgtagcagagaacacagggtttcaatggtcagtggagctgagacagaggagggcatttcagaaggaagcagctaccagctaaggctgaagacagggaaacactgtgagctgctgcagggaggcaggcagagcagaacacggagtggggctcaggcagggcctggctcctgggagtgcctggacgtgtgatccttcccctcggccgccaaagtcccaggactagcactctagaaatgcatgtgctcttctttcccaaagaaccccagccccaggtcaatgaaatggttaagctggacttctctccacaggtggcctgattcttgtgtgaactgccacctgtcatgacacccaatccagacaatgtcctttaaatttgtccccatctgcctatcaagagattacccatagtaaaatacatacaatataaaaataaccattttaaccaattttaagtgttcagttcagtagtgttaaagtacattcacactgctgtacaaccatcaccaacacccatctccagaacccttttcattttcccaaactgaaactcaataccccttaaatggcaactcccatcttccatcaccccaagccctggcaacaaccattctacctcctgtctctatgaactggactactccagatactgcatataagtggaatcatacaatatctgtccttttgtgaccatcttctatcatttagcaaaatgtcctcaagattcatccgtgttgcagcattgtggtagaatctccttcttttgtaatgctgaatgatattccagtgtacagatatgccagttttgtttatccagtcatctgctgatggacactaggattgcttctaccttttggctattgtgaataatgctgctgtggacagggtgtccagacatctgttcaagtctctgctttcaattcttttgggtaataaccaaaagtggaattgcttgatgatgtggtaattttatttttaatcttttgaggaactgccatactgttttccacggtgtctgcaccattttagttcccataaaaaatgcataaggttccaatttatccacaaccttgccaacacttttttttttttttttttttttttttagatagagtctcgctttgtcacccaggctggagtgcaatggcgtgatctcagctcactgcagcctccacctcccgggttcaagcaattctcccgccttagcctcccgagtagctgggattacaggcacccaccatcatgccaggctaatttctgtatttttgtagagaaggggtttcaccgtgttggccaggctggtcttgaactcctggcctcaggtgatctgcccgcttcggcctcccacagtgctgggattacagaagtgagccactgcacctggcctcaacactttttaattcttattttaagtagccgtcctaatgggtgtgataaggggtactgagtttcagtttgagaaaatacgatatctcactgtggtttaaaccaggacacttttaagagtgaaggaggcaccacctgtaattatacagaggcatgggcgcaagctggggtgacggcagctatggtccgtccagggcatcacacggggagtggtgccactggggccttctgagctccccggggctggggtttggaagaccagagcgccaggcttcgttggagagcagaatagccttcttaggggcccagctcctacctatcatctacccagctgcctgtctacctgaattcccctagttgctcactgaaagatagaagaaaatttcccagactatctccaggtaatcaaggtggagacagttttagaagctcaaggaggctcctgtggaaacaggattttaaattagttgaagtctcacgtaattaaaatgattttgattgtaatggtcacttcagtaattccttgtctatgaaaatatttaccagcattactattgtacaccttatcacatcagtcaccatttgaaagaagtcaccagccaccctaaccatggaggtgaagagttgagagtgaaggaggaaacggagtgtttgactttatcctttatcactcgtcaaggccaatggcgaatcatgtcgctttttgtttttttagtgcgactgtactacctagagacacgggctatttggaatcagctttttgttttacacgcctctttccccaaaatcatctgctaaggcttgacaacagtgctgagaggcggacgggtgactattactctctccacttgacagatgggaaaaaagactcagagaaataaagtcagtcagtcaatagtcaggggtacatcaggcaccgtacacgtgccgagatttgacaggcacaagctggggtttgctgtccatggaaggcaggaaatgaggtgtctcagcacagcagtgatgagggtcaccaaaaggcaagcagatggtgctgtgtggacgatggcaatgcatggagggcctgctgggggatagggtgtttaagctgtagcctaacgtatgggtagaaggtggccaggtaagctggaggggaggaaagaaaaggagccaggaaaggaaaacagctccagggagaaggtccagcatgtgtgctatagtttgaatatggtttttctgtcccccaacaaaaccagcattggagtttgagcctcactgtgtggttttgggcctggtgggaggtgtttgggtcatggctgtggtggatccctcatgaaaggctcggtgccgtcctcccagaagggagtgagttctcatcctggcaagatgggattagctctcatggaatggattagtccatgagggtgggttcttacaaagcgagtggttccccacttcctggcccctctttgcacctgcccacttctcctctgaccttctctaccatgtttggatgcagcacagaagccctcaccagaagccaagctgatgtcagtgccccacttcctgtacagcctgcagaactgtgagccaaataaacctcttttcttccttcctttttttttttttttttttttttgagatggagtctcgctctgtcacccaggctggagtgcagtggcatgatctcagctcgctgcctcctccgcctcctgggttcaagtgattctcctgcctcaacctcccgagtagctgggattacaggcatgtgccaccatgcccagctaatttttgtatttttagtagagacagggtttcaccatgttggccaggctagcttctgacctcaggtgatccacctgcttcggccttccaaagtgctgggattacaggcgtgagccactgtcccaggccacatcttttctttctaaatcacccagtctcaggtatccctttatagcaagagaaaacagacaagacaatgtgcatgcacaggtgagggagaatgaaacctctgtgactgtctgtagtcacatgaggctatggcagagctaagctgtggcttggcagagccaaggcttgaaggggacccaggaaatcactggtgagcccttccgattattcagggaatctgcatggtctccacagccctggagtttcacttcctcattgaggcaagggagttagatgactgaaggccggtgcccagagaaacaatatatgggcagggttcacattttaaaaacccatggcatacaaagttggtgtagagaagggagcaaaatttgtccttcattttcaaatgctagtgaataggtaatagttctccagtcagctggaatgaaggggaaaagcttcaagaaatatgtcttaggaaataacgttggcttggcactcccctccttcattatatgtctaaacacaaccattgcacttttcaagttttttttttttgtcatcttctatatttaagtgcagaacacagaaggatggttgaagtccccagatccacttccttggatagaacagaactagacgaggtgtgttcttgcaagcagcccccagcagaatccagccatctgggcaggagaacagagcagcccctggccccatgtgcagtgctcagacttgtgctgtgagcacgacttgaggcagagctggattctgtcatacacacacacacacacacacacacacacacacacacacatatggttgctgtatatcatgtatatgatatatatctctatgtacgtgatatatacacaacatatctatgaatatgatatatacacatatctctatgtatatgatatatacacatatctctaggtatatgatatatacacatatctctaggtatatgatatatacacatatctctatatatgatatatacacatctctatgtatatgatatatacacatatctatgtatatgatatatatacgtatcacatctatgtatatgatatatatcatatatacatatcatacatatacacatatcatatatgtatatgacacagggtcttgctgcatcactcaggctggagtgcagtagcacaatcatggatcactgtaacctctgcctcctgggctcaagcaatctttccacttcagcctcccaagtagctgagactacaggtgtgtgccaccatgctaatttgtgtgtgtgtgtgtgtttctgcagagatgaggtcttgccatggcacccaggctggtctcaaactcctagactcaagcgatcctcccaccttggccttccaaagtacagggattacaggtgtgagctaccacatctggccaattttgttctatttcaagggcactcaggttgatggaagagggatctctcaggcatctagctccatctgccaggccctccctgctgaaggccacaatgccacccctaaacctggctctaccccctactgtgttcattaaccttgggcaagtggctccatctctctaggcttcagtttccccacatgtaaaataaggatactgacatttgtcccctgggctgtctggggatgaaatgggatgatggcagcaagtccccagcacagggcctggggcagcaagcatgcaaccctgagagactacgaggtcacatacgccccccacatctgccaggaccacatgcctttgccagagaggggcaggttatcatctggcttggtgggaaccttccaacaacagcgaaggccatgaccacagtccttctgtaattccattaaatagtttagtggctggggccatgattcaaagagaacctggacctccttcacgtagtccctcagatgactacaccttaatttgctgtgcttgcattgggtccatggttatttttcttggcttcttagcaccagcattagccaggctgaataggggtttctgtctccaaagtaagatgaggaactgtggcctaatgtggctccctgactcactggctgggaacagggtgaacagggccacagggaggccatgtggggagctgccagggcttcagactcttggcctgggctgggcttcatcgaggccctgtccagtcggctggattggggccagtgagcaggcttactttgtctgtgaaatagaaaaaggggccatggactcacccttcacaagcagttggttcacttcaacattttaatggaaccgacctgaaattaatgagcactgtcacactgagtaaatactgcctctcgggatgagagcggcaatgggtagaaggcagtgtgacaattcaaacccaaggccacggacaattacatagaggaagtctgttcagaatttggcggatcgaatggctgtccccaaataacaggcatgcagatggctggagtctgatgctgcctggcgagggcagaggcagatgctgcattctgagggccagcaagaggacacgacgtggcagtgggccagccagccacagccgggagccagcacaggaaagggagttggacggagtcagaaggtcaggccgccccagtgaacagggagcacattaacctttccaaagccacgggggagcttatcaggctccaaaatgcagtcatcaaaggccagccagcccagtgcagccaaggctggcccggggctacctctgggagcaggtcacggggcggcagcctgtgagcggaggtgagggcaggccctgtgcccagagtgagcagctgcagggtggtgtgctccagctggctctgggagtcccaggctggagagtggaatggtcagggtgggactgttccaggggtgggaaaaggggggaaatggagaggacgggagtgggtagagggtgctggcctgaagggctcttaaagccagagagaacagactccatgggctttggccagttttctttactaaaaggagatgaaaaacagaacaaaacaaaacagatttgatatcatgactttaactcccatgaaaagtagttaagtagtttggttttaaacaaagcaaaacaaagcaaaacacctcagtctatctattggctttaaaaccacccactcatcacagatgcttttgcggcacggcctccgcccactgcaggcacaggcatgagtgatgaagacagtggcacctgtgttcagaaacacatacgggcactgaaatgcatcttttttgaatctttttttctccctgtcacatatatcatttgttgcgtttggattgcttttgaggtcagatctggctcaatgagaatggggacgacatatgcaaaattaaaaaggggggactaccaggtgtaccttcacatggcatcagtgtaaacattctaacagaaccgaccaccaattaaccaatcaccaaccaacacattccatgcagacagcaagtgcttaatttaatctaagtacattcaagaaggaacaggtgtacttctacttcagaaatagatattttaaaaaaagaagtagggtagacagcagtgacaaacactgaaaactatgctaattaagtcttctctctcttaattccaactatgagacgtcatgcgtattggatacttaaaatttttttggatgtaaatttaaatataagttaaatgaaccattatgcattagatacacagtgttatgttgtccttggtctagaagggacagctacattggcattcaaaaggagtgtgacatagtgacaaagactcaagtaaaaataatttatagcttagtgatttcaatattttacccctggtaacttaatatacttagtctgaggatgagttcagaagagaggtagcacaaagtgggatgacaacgggccagaaccagtatttttttttttttgagatggagtcttgctctgttgcctaggctgtagtgcagtggcatgctcttggctcactgcaacctccgtcttccaggttcaagtaattcaactacctcagcctcctgcaggtgcacaccaccacacccgactaatttttgtatttttagtagagatgaagttttaccatgttggccaggctggtctcaaactcctgacctcaggtgatatgcccacctcgacctcccaaagtgctgggattacaggcatgagccactggccagaaccagttgtcttttcactgcctctagggacagtctggttccctttggccctttcctgtgttcgcagactgcagcgaggctgggggactccggtggtgggggtgggggactctggtggtgcgggttagtttttctcgtctgtggtcacagacacctggctaaggagcaggggaggggtggtgggtggggctgtgcccagctgtccccccgcccacagaggatctaagtaacttgcaggaagtcttctccactagcagagaaggaaaggacgcatgtccaggctaaaactccagcacctcaaacccaggaaagagaacatgggattcccagcccaggcctatgagaaagggggcatctggaagaacctgggaaactggcatctgcaggatgtttgctcttaccccccaccgcctgtttttcctgtttttaattctggaaacatacacataacatcaaattggccaagggtgtccagttaggtggcattaagtacatgtatgttgttgtgcagcctagaccactatcattctttctgaaagagatcaaaactcttctaactgtgccccagatcaagtcaccccatgtgtttctgcaggctcgtgggaattgtgaacattgacttgaatgggttaaaactgaatttcacccggaggagccttgggctgtggcctccttaccagacatcaggcagcgagtctgtattagtcctcaggaatccctggccactaaaccatcttaaagggcaattagtggctttatacaactcgttatttatttactcaaaagactgtatcctcagcctgctctcttcttctattgtgtaaaatacatatttgggaccttttaaaatgtgtgttatgtacctgatagaactcaatggcttctctggagccattctgttttattgtggaaattagtactaggggggcttttaaaagctgatttttagacccgacagcctgcgtttgttcacgttaatgcagtggattgagctaacagccaccaaagggctgtgagggacacctctgtggcctctctgttggagcagtgaggccaaggggctccacttttgtgactatagatggtacttgctgggcctgttagagaggagaggactgcatggagactcagttggcacttatctctcttcacactgcccccgacagttctctgccagggctcccccacgttattgaacattactgtttgcttttgaaataataagtattatttactttgaaattataaaatgagaccaattctttggagattagctggaaaggtgtcaggatatgacccagggtgacttttttatgtatttatttttttaattaatttttttttttttttgagacagaatctcactctcacccaggttggagtgcaatggagtgcaatctcggctcactgcaacctctgtttcctgggttcaagtgattctcctgcctcagcctctcgagtagctgtgattacaagggtgtgccaccgcacccagctaatttttgtattttttttttagtagaggtagggtttcaccatgttggccaggctggtcttgaactcctggcctcgagtgaggggaatcctaaagtgctgggattacaggcgttagccactgcacccggcccaggatgacttttttccgtgagtaaagtaaaaagacaatgtggcagaaacaggtggtagcctcctcggaggcatgcaggagcctcacctgggacccaaagacccacagtttggcttttaggagaaaacaggctctagtaaaacatatttcaaaatagggatggcgtgagtaatagaagggatatttcttaggatttgttgatacttgtttttctataatatcaatgtaaaaacatgccccatactactagttatgaattgcttcagacattaaacccatactctgttatcttcttctcttggtttttaagcctcttggtaggacttaaatcaaagaacatcttatgatacctcatgcgtgatttttcttggtggtgcgatgaggtaattactatcatatggagggagaaaggaagcgcctcttctattcatcacctcttttaatctgtacataaacctaacaaggagggcattagtagcatcctgcttctgcaactgggaaagctgagacttggatgtgtaaatgctttgcccaaagtaaattccagaccaagttcaaggactcaaagtcctgtgcttgcttcacgatgtcttgtaaaaagaggagagagtagggaaagctgggccagagggtttttttttttcttttgctttcttgtctccttaatcatgacagcataaatgagtggcataatttgtattcttggtcttactgcattcaataagtcatgattgagcagtcattttgtataaagtactactaatagtcaagatgtggttcttgctctcagtagttaagaccagacataaataaaggaggcagagactgtaagctgggcctatgccaggaattacatgaggtgctgatggaataggagctgtgggcgctggggcagttggctatttaaggtttccgtagaagatgaggcttgaccccatgcttgagggatgcactgcgtaaccgaagatccctcccatgagttcttgcactggcagctgtctagagctggcttcagacactttctactcagatgcccacagccacagaggggaggcctgccactccctgtccaccctgcagcctggccctgcccaggccattccttctgtgttctcctcccttctccactcctgggtcacccgatgcttcctgtcctccacatgacacctcatatgtgtcctcccccttctccttcccctgtcagagagtagggtaatattgtacctgtgtccctccagtgacactgatttcttcatagtctgatgcagagggctgctactgaagtagctaagagcaccaactctggagctgcacagaccactctgtggctttccagactgggggtgaattacctgagtttggaaagcaagactcactaggattttagggagagtactttagaagatgaaatgaggccaggtgtggtggctcacgcctgtaatttcagcactttgggaggctggggtgggtggatcacctgaggtcaggagttggagaccagcctggccaacatggtgaaaccccatctctactaaaaatagaaaaatcagctgggtgtggaggtttatgcctataattccagatacttgggaggctgaggcatgagaatcatttgaacccaggaggtggaggttgcagtgaactgagatcataccactgtactccagcctgggcaacagagcaagactctgtctcaaaacaaaaacaaaaaagaacacgaaatgaaatgaaatggagtttcatggaaaatatctctttaaggccctcacattgcattcttccttcctcaccaagagagtcgtcgcgaggactaaatgaagtaaggtatgtgagatgctcagtacactaccggacctgcgactgttctaaggagatctatgactacttatgtgtatgccagcgttgtggtatactcagtatttatgcacaagcctacatgtcctctaccacactgtagattccctgcgagtggaatccttgggtaatgaatttttgtgtcttctatagagaccagcagaatccctaacattttagggattcagtactgtaaatattcactgaatgaatgaagaagtacaaatgcaaaacataagtatgaatagttggtgaagacagcacactttaagtcatgtcaacggtacgaagcacaaaaatgagggggcaggagagggagggaggagccagaggctatctggcccaatccccactcgctacaagagacttctcgatagcatcatatagttctcttttgttattgagttctaatctaattccactctaatttaattatactgagtggttttgatctttttttttttttgagactttcttgcctacttttggactgagtttttttctcatttttccatttcttccccctgtgtgtttggattctataacatccatacaagcaggcatgaacacctctttgagccactaagcgatgagcccctcatcatctacctgtgattcctgaggcatctgttgcaaggatggatagccacagttgcaaagaattatttcctcttttaagcccaaagttgccattattttaaccacaaagcattggtctagctcatccattcatttatcaaatgacttacggtgtctgctaattgccaggtactgtgctaggtgctagagataaaaaggttaccaagccagaaatattgttacgatgcaaaacgtggcccaaacctcctatctccgaccccagccaagctgctctattggtgcttgatgggaggcaagagaatcatactgaccaggagtccagggacctgggatctagtcctggctctgccacttgtggccctgggtgagttgcatcacctgttcgcggctcagttttctcatctgtaaaatgggccccatctatctttcagggttgttgtgaggatcataaaatgagacagtaaatgtgatagtgattctaaactctaaagctctcaaagtttttattcacaacttaattgtacatttaaaaataactaaaagagtataacacaagggataaatgcttgaggtaatggattttttaaaagttttttattcatatggcatacttaaaagattttttttttttttttttttttgagacagagtctcgctctgtcatccaggctggagtgcaatggtgtgatctcggctcactgcaacccccgcctcctgggttcaagcgattctcctgcctcagcctcctgagtagctgggattacaggtgcacgccaccacgcccagctaatttttgaatttttagtaaagatgggatttcaccatattgatcatgctggtcttgaactcctgaccttgtgatccgcccgccttggcctcccaaagtgctgggattacaggcatgagctaccgagcccagccctaaaagacttctttataaggagccatattgctttggggagaccgaaggctgctgagggcctcagggcagggttgatatgcacctgccagcacgccaccataacatcttcatggaaccttaacactttcttaaaagtgctccacctccttttttttgacccttaaagaagagaccaactattagtactgtgtggcaactgtgcctgtcctctcacatggccaggggactgggtgacacattacccagaaaggtacacttctgtgctggtggccactccaacacacttcctttgtttggctggagctcgtccacttgacaaggggtcaggaagatgaagctgaatccaaccccctacactgccaggtgggtacccgctgccctccccaccttgctatggaccatttctgatctggcttctggacacagaccatttcacattcttctacctacatggaggtgaaactcccttagttttaggcaattcctcatttacttaatttcattatatactccctaatgggcaacaaggagattggatgtgtgagatttatttgagaaagggcaaaactgagggcagcaaatgtgtaagccttgtgagtcctttctccttgcaaaggcaacactcgtctggctggtgaagccaagagcacagccacacggctgtttctcatcctggcacccccagccccagcacagcaccccacagagcatgctggatgcgttcagtaaatatttgtgaaataaatgaataaatcaatggcagttgtttggatttcaatataaatggatcttgggcctgagatactgccagatgggcagacaggttacagtctggtgatgcatctccaaggctataaaaatgtagccgttgctggagtcgcaggctgacatttcagatgattatatgcacaatttaaccacatggctatctgtgccctccaagtgccatcgcttcaacaactgttttcatgttggcttttttgctcgttcctctctctttttttttaagtcaagcataattttttgcagcctctcgtatttctagctgaacgtgatttattcatataaaattatgttccatttttataaaacccaagttactgcaaatgatgcttgaggtttcacagaaaatattaattcctgatctgctgctataaagcatgcctgctcgctgagagcagcgctgtcactctgagacagatggaagcagtccaagggtatgattaacttcttagtcctggcaattgcctagtgctcctcttgccctagatttcaagattgacctccagcttctctgcagacgcgcagttgctcagcttgataaatcacatgaatcccttttttgatcagagttatctactatttactactcatgaagggaagttaatcgtattcaaggcacttcatatgctgcacacatatccttccttcttcctaacggcactttgcatattttccacattggcggtgatgtggcttctttcgcagtgcagagggtccacaccaaagatccacctttatcctgtttgtccttcttctttgtctctactaaccagcatcaaatacaccgacccacaagaagaaaaaacacgagaggcacacaataagcagtgaataagtgagacgaattctgtccctttgcaaactgagattttcttgtaattggcttctttactttgtcaagaactttgctgggccgagtgtggtggctaacacctgtaatcccagcactttgggaggccaaggcaggcagatcacttgagcccaggagttcgagacctgcctgggcaacatggtgaagccccccctctacgaaaagtccaaagattagccaggcatggtggctaccatggcactgggcagggcacggggagagctgagatggcttgagcctgggaggtcgaggctgcagtgagctgtgatcacaccactgcactccagcctgggtgacagagtgagaccctgtctcaaaaaacaaacaaacaaacaaaaccagaaaagaaaaaagaattttgccatctcttcttgccctgtttgtctgcttttttcatttctgggggacataaatgggcctctggtaggccagttgactctcagtggtataaaatagataaaaaaattctactgtccagagtagaaaagaacagacaacacaccatcccactctcacacaccccttcttgtcactgctgggcgggaggcgcaagtgagtggggctgaagcccaaactccccttctgcttgccatggtgatccagtttcaacctgaagcacattttgcctatttggggtgaaccataaattaagtccattggtcaggcaaaaccaagcaagggaaaaggttttttggggatgatcacagttgatttttaaaatttatgtaacggaaatatcacagttttaatttatcaagatgttatattgattacagaagattctctgaactttaaagcatacagtctaaactgtcagatattggatttgtgctgaaatgccaatttagaaaataaatcaggcgactggagaaatggaaagacaagactgactttccaaagacatctggacattctctaacctccaacaacccagagggatgagacttctacccactccttaggaagggaaagggaaacacacccctttctttttcttataactggtctcatcaggtcagatctcaaggctttgaagttgggcttccttatagggaaacagataacaaaaactggcttcctacagtgtaaactcatgtccttccaccaaccccaagtcaatgaaatcctgtttcatcatcgatttgtgtatcttggaacaaaatagctccggccttgtctaaatgtccttgtgttcactggacactcaaggttgaggctcagtggaagtgaaatgagcccatggatgagcaaacttataggacactgaggttctgaaggaggataagacccagagtgtgtcacagacatgctcctccatgaggaaccagtgtgcatggccagagccagtacgggcttttctgtcctgtcccagaattatagaactcaggaagcaccttttgaggtctgaaaagtgcttctcccccaagaacaaagatgaaggcatgagctaatcattatgaaattttatataaagaggtgataacaggctgaaagcaaaaggtttagggaaccaggatggtttgtgtaaatgaatgtataataggttaataccaggctccaagtagccagagatattgggcctagaaccccactttgggatattcaggacctggggagatctttactcaattcctttcccaccctgaggttcctctggcagccagaacattaggcaagtcatacagtggtctgacttgaggcactcgggtcatttttctagaaaatattggtttattcaaaagaataagtaatgtgagagaaaatgacatctgtcacttgataagttattctctacttaaaaactagaaaatatgaatgcaattaattcagcaagtgttttaaaatcattattttgaagaagggttttaatttccatcttgaaatggttacaaatgcttatcacttatggggattacgtctgtggccctgaattagtagagaatagacaatagaaaaagaatggctgttattgaaaagtcaaaaaacaacagatgctggagagcctgtggagaaaaacgaatgcttgtacactgttggtgggagtgtaaattagttcagtcattgtggaagacattgtggtgattcttcaaagacctagaggcagaaataccatttgatccagcaatcccattaatgggtatatacccaaatgaatataaatcattctattataaagacacatgcacgtgtacgttcactgcagcactgttcacagtagcaaagacatggaatcaacccaaatgcccattaacgatagactgggtaaagaaaatatggtacacatatgccatgaaatactatacagccataaaaaggaacaagatcacgtcctttgcagagacatggatggagccattatcctcagcaaactaatgcaggagcagaaaaacaaacaccacatgttttcacttgttaagtgggagctgaatgatgagacccatgacggggaaacacacactgggtcctgccggtgaggtgtcaggggagggataacatcaagaagaacagctaatagatgctgggcttaatacctaggtgatgggttgatgggtgcagcaaatcaccattgcacatgtttacccatgtaacaaacctgcatatcctgcacatgtgcccctgaacttaaaatacaagttgaagaaaaaaaaagaaagaaagaaaaaagaaaacacacagagaaggtagctttacacaactgcactgctagaatagcaaagtcagctcgtcactttgaaatgaccaattctgaatagaaaaagtgctacagtaaagtaagggaaatgccctattacatttgaggataaagaaatttgtaagaagagtggtgacaatgaaaacctctgtttttgggtggggaatgggcttgacaagggattttttgtgaaaatatcagaaaaaaaggaaatggcattgttcatcattaacatccatggacattttctctttaggacaaagttgtatatgttttgggaagaaatcttcgaatgtatcagtcctagtttctgatgaattgtctttgtatttgtgaccatgtcttcaaaataaatccttattttcctaaaataggttttgattcattctactaaaggtcataatgaccttttttttcctgtatttatatgtgtagctttactaaaatataatttacattccaaaaagttcacccatttaaagcatacaattcagtggtctggtatacttacaaggttgtgcaaccatcaccataatctatttttacaacatcatcatctccaaaagaaatcttgtactcattaacaatgaccaagtttcccttgcgtctcagtgcattttgttgaaggaactgcttacttaagaagaaaagtcaaagacagaaaagaaatatgtataggaaagaaatgactatgttatattctacatgtgttttgatctagactctttcctcctcctactgacacattcagaagcagagcagtcatcagcttttgtgaaaatcccaaaagcaattccagaagatcatgtgccagccactcaggacacgcaggcttgtgtggttgtcatggggaaggttttgtaattgaaataaaaatactcatgctcagtctgccaccacacagaaaatgcttttcactcatgcacaccagataattcgcctaagtgacaggttttactttggaggaagcaccgagctaagctggtttacacagtcaatgatggctcattccatgaaaaaggaactgggaaggaaggcagggtggtgaaggttagctagacaatgtggaggtggctgccagccagtcagccaagggcacagctcctcctgctgcttctaatgctgtggagacacacagggatttcatctttacctcctgacagttcctcaaaacacgcgcgcacacacacacacacacacacacacacacacactctctctctctctctctctccaatcttagtaagtgaaaaaacaaaaaccaaaaccaaccaaaccaaaccaagggtctggtctattctagaaagtgactttacatacccacattcaactatctgtctacagcctttcagacaaagcaggatataaaatacagcctgtgtgtgtttcttgatgaggtttacacatctcattcagtaacacgcgccaggagaaagacgccaaagcaaggagtaaaaagtcaagcacgtgggaccgtgagttgttgggttatgtgcataaaatatttcaagagagagaatcttatcaaaagatagatagctcccggtgaaatgatatggaaaaagtctgaagaaaacatctcaaaataaatgaagtatttattgctgaaaaatgagcttagatctcagccagttccaaagttcagaatttaccgcaccactcaggcctttctctctaagtttcttgtctcttgtttcattgcacaacaagggattcttcatacttgctatgaaatacaacaaggcgatttttgcagtgataaactccacacatgcatgataaatccaagcatgcaaaatgtttaacatcccagttcagagatactttagggacaaaatccgattatgaattatatgccacaataaatagggctcaatgtttcataaagcaatttatagttcataaaaatgacaaaatgtacctgtcagagagagcgcggagagccgttctctgagctgcctgctggaagaaagaaagggcagagatgtttatttaatattctgacttttgaattacgtgctcaatgaacacttaaaaaaaagacccctgcattacacacatttttgccatgtggccaaattttaaacgactagcaatgaagtagagagcactgttgtaaaatgtgaaatgtgtgtgatgaaatgaaccttcacggacagttaactgaagcccggcaatgcacacctgcaactaggggatgagtttgtcgggggggcaaaggactgtacccaggtaagcttggacaggcctctggaaattggcaaagaccagagctacttctctgaaatcactttcccattgctttattgtcctttcctataagaaaacaaaaaggtctgttttggtttctttgtagcttctttcccaatgaaggtgtaatttttcactcggatttcagattgaaagtttccacagttggaatatggaatgccactagaaatctcaagggattattgatttgctttaggcatagttaatgatattatgacaatggtttttaaaattcacattgaaatgttaatggatacaattatctgctgttgggatatgctttaagataatacagtgggagggctgggtgcggtggctcacacctgtaatcccagcactttgggaggctgaggcaggtggatcacctgaggtcaggagttcaagaccagcctggccaacatggtgaaatcctgtctctactaaaaatacaaaaattagctgggtgtggtggcatgcgcctgtagtcccagtgactcaggaggctgaggcaagagaatcgcttgaaaccagaaggcagaggttgcagtgagccaagatcatgccactgcactccagcctgggcaacaagagtaaaactccatctcaaaaataaataaataaaataaaaaaatttaaaaaatacagtgggagaagggcagagtgggtgggcacatacataagacaagatggccttgggctgagaactgctgacgttaggcgatgagcacagggcaggttcttatattattctggccatttccctacatgaaatgaacaaaactttcattttgtattgaaaatgtattgatttgttttttgtttttttcttctactaaaattaatgtgtgtgtgtgtgtgtgtgtgtgtgtgtgtgtatgctgaaatttcccataataaaaaaactaaaagaaaaaaatcataaaaaaggctctattttggccgggcatggtggctcacgcctgtaatcccagcactttgggaggcccaggcaggtggatcacctgaggtcaggagttcgagaccagcctgaccaacagggagaaaccccgtctctactaaaaatacaaaattagatgggcatggtggcacatgtctgtaattccagctactcgggaggccaaggcaggagaattgcttgaacttggggggcggaggttgcagtgagctgagatcgcgccattgtactccagcctgggcaacaacagcaaaagtctgtctcaaaaaaaaaaaaaaaaaagggctccatttctccatcggattctcccaagttttgtacttgctttccttttctctggctattctatttttcacccatttgccttctatctctgggcccaatgaggccaaggaaggcagatggcacacgatgctctctgtctcagaagtcatgactggggaggtcagtagaccaggcctactcagcatgcaccgggaaacaaggagtgtgcaatggtcctttcctctttgcatgatacacaggtcatggttactgtttttttttttctgagacagagtatctctttgtcacccaggctggagtgtagtggcctgatttcagctcactgcaacctctgcctcccaggttcaagcgattctcctgcctcagcctcccaagtagctgagattacaggtgtatgccaccacacccagctaatttttgtatttttagtagagacagggtctcatcatgttggccaagctggtctcgaactcctgacctcaaatgatccacccgcctctgcccctcaaagtgttgggattacaggtgtgagccaccacgcctggcctatgtttactgttgaccaaggacctcacaatacttctcatgctgatagcccatcacatttagatatcaggaaaaatagaatcttcaggttagaaaaaaaagtcacctcagaaccattttctctgttatggaaataaaatacacccttggtgacagttccacatcttgggataaaaataaaagtagaagcagttatcgtcccagaaaagctccttcctaaggtaggagctggatgacctcggtacacttttagaataacatggacatgaaagattaaggcagggcagtgtcaggaaggtgcagggatgggcggccactcctcaaatggtgcctggaaccatgagccggtgtcagtacatatctgctgagtaaatgttagagggatgaatcagtcaggaaagccttccctctgaaatctgagcataattttaaagacaaggaaggatgtggtcaggagagagaaggcattgatagcactgggctagacggcacagcaggggcctgtcccagcctctggcagcagctctcaaccggggcacccatgactcccaaaccctgggtgtctggaattgatgagggtgtttctgtgcattacattcatgagggggatcaataatggcagtagtgtctggggccagggatactaaagcccttcaaagagcaggaaggtcccttgtataatgaagaattgtccccttaaaatgacaaagggtgcctgcagagaaacactgcggcagagtaggaatgaaaggagagcagaaagaagggctgtagggaacatgagctccagggcctggcaaagataaggggaattgagacaacttccataagtaatgcagcaacactgaattaggaaaaccatctagtgtgttgagccggggttggagagtccgacattctgggacaggttttgccattcatttgctatggaccttgcgtctggccttcaacctccggcttagtttccaaaccaccctttccttctctgaatagggtgctgaaagagacagtcagtccgtgtccaggctactatggacaatccaaggggttactgtcccctcctcattccctagattctgaatgaagaccccatgtcctggtattccattgtcataggattaccacaacagataaaagaatacagatctactgatcttcttgataaggagagctgagggagcagcgagaggcaggggaagaggaccggagcctgaggaacccacgcagacacctccagggatgggtgcttccctctcccctcagtccctctcctgtgctcttccatggagccagcgcagagcatgctgataaaacgcacccagcaggcaacaggtggcatcactgctggcaggtttgtctcctggagagtttccctctcactcagcaagatggctttcgctttaggccgcgatacttgaacttaatttaactccctactcctgactgtttggctgaatatacaagaagtatttttgaactgccccaaagaaaggtggaatgtattattagtattgtctcttaacatcatctcagcaggagccatgagagactggctcctcctggagtaacagaaatcataagaggtgtaactaaaagttcaatagaaaccttcaacatggcatctgaatttctccctagtcatggaaatagaccaaggctgtcaatattttaaaaggctattgactcttttctctcccacctccaaacaattcctgctgacttctgtgatacggaaacagcgcttgctgatgtgcagctggtcagaaaatgatttaaaaagcgaaaggaaaacaaacaaacaaaaagaagaaacactgctgtctggccgccaatggagtgcctaggaattgaggcatcccagtggcggcacctgttggcaatgccacaggactgatgttagccccgtcttctaatacaagctgagttggaagcttagagcaagggctgctttcctttagcagactggtgtgatgctgggaacaaaaggtccttctgggccgagagacagggcaccctacgaggcactaagcagtgttctctgttgattcttcactcttccaatctgtcacatgatgtatgctaccacgcatgcaacagcatggtacttagcaccatcaattgcctgcactgctttttttctttttttttttttttttgagatgttgtttcactcttgttgcccaggctggagtgcagtgatgcggtctcagcttactgcaacctctgcctccctggttcaagcgattctcctgcttcaacctccagagtagctgggattacaggcatgcgccaccaaacccagctaatttttttgtatttagtagagacggggtttcactgtgttagtcaggctggtctcgaattcctgacctcaagtgatctgcctgcgtcagcctcccaaagtgctggggttacaggtgtgcgccactgcgcctggcctgctctgctattttttaatgactaattttcattgtgctatttaatttgcagtcactctacatcattaaaaattttacaaaaactcaccatctattatgaaagaagaggagtatatgtcagatgttttaaataatttgaggaaaaaacccttcatggcattatattaattgtatatataccagagcaaaggccaccaagatgtttttactgactcctctctttaaaaaaaccttcagcttttgcacactattttattttactactggaaaataatgaaacgaataaatattggaattaaatggcaaagaaaaaattaggtgactcatgattgaaacttgaaaaagtactcatagtaaactagatgaattgcccaatttcattccttcaagagttatacattacagcaactatatttttctcttcctaaatctcacatcatctcttccttgcgacttgccttttattcagttctcagcaaaataggttgagagggttaagagaacacgtcattgatccttcctgagttcattattcattacgaatgattctaaactccagtctatgagacaaaacatgttcttttttttctgccagaaattgccattttcaggttctcctcaagagatgacatattttctctgtctttattatagcaagcttgttgcttgggaacacaatcagtagatattcaggtttcaatgtatgctaaatgaattacaagtcacattctgttattgaagggaaatcaaagaggaaattaaatgcccttattgtaattgggtcaagcactgaacaagctcatggatcctggagtggggaggaaaacaaagggagaggctgaaattcagagggctctcagaatgatctcatttcttacttgatagaaacagaacttacgcctggagaggtttgtaattcagtctgaagtacctactatgtgcaagcactggacttggcttaggtggcagtcacaacaagcaaagcccttgcaatattgtgcttagtgtctagaggtggggcagacatgaaaagctacacacacacacacacacacacacacacacacacacacacacacacacacacagcagtctacattccaaggggcatggctgaagaggacagggtgctctgaaaccaactaatgaaggaaaccttgtttggaatgagtgtcaaggaaggcttactaagtaagaaataacaaagctgaggcttaaaggataaagaaaaatgatcacatcagagaaatgggggtgggtggcgaggggagtgctctaggcagggaagctctagtttgggagcaaaggccaggagctggcctagatcctggctcagctgaagaactacaagatgtcactgtgctgcggttcggcaagtggtagggacagcagcagagcaagatgaggccaatcccaagggttttagacatcaagtgaagtatgttaggtattaacacaggacaatagaaagtcatcgaagggtttacattaggggaagctgggtgaagcatgcatggggcttgcttatatgttctttgcacttcctgtgaatctattatataattaaaaaaaatagtacggagggaggcaataagatttttcaaacatcttgctggcttctgcatgatgaatggaattgggtaggaagcgacaaagtttgaggttattgcagtgatgtgggcaagagaagagcatggtagtagtgaagatggagagagctagtgttacattgtgaaggtctgattgagggaacaggtgactgattggatgtggcaggccagggagaggcatcaggtgtgaggtccaggtttctggcttgggcacctggtatggatggagatccacttgttaagtggattaaactgggggcataagagcagggggcaaaggcagaattgagtgttgggtgtgtgaagttaaagttgcctacaagatgtttcagtggagactctgagtagctagctggatgcatgcgactgaagttattaaatgccaattaagtaagaaacatcaataacagtcataaaaaatggattgaggtttctggatctacattttgctactgttctaagagaaaaagatttaggtttcaactggttgggatatatctttgtgttttcattatggatgtcagtaacctccatttttgctatcaacagtatcagatttattctgctgacaataaaggaggtatctctgcacagggattttaatcagcttgttgcacctgtgataggacattgtatccatattcaaatacttgaataaacgcccttgcagccaatcttagtttgtgttttgctgttactgaagcacactgtaaaatttagacccaatcacatatttttatagaagttctatttgtaaagccttacatttttgctgttctttttcaagttgagacttgtacttattaatttatttcacggtttaatttccttccacatctataagcaattttatgtttcattatctgaacttttatgccattgttttccacttcagtcctagttaatgggtctcttaactttttatgttgtgggcttccatttagtatttttcaacccgtttagtaatatctgcaagacaaaggaaaaattcttactcctctctattttttcctcagcaataatgagtcttttgcattttcggattcctagaaataaatgctgcctaggaagcattttgttcggtcaactttgacctcatcccattctctataggggtcaggcagtcagggatgataatataatttatcatccaaataagaacaaatttgagagagaaaggggatgctaaccagactggagtcagagacaaaacgagaaaacctggctgttctgggcacatggggctgtacagtcgctctaatgaggactgctctgtgcaaatatgacttgctgcttataaaccctgttaaataagatcatgataagaaggcagacctcagggcctgaggagcatgccaataacgaaagcacagagctgaacggggtcagcagaggacgaatccttctaattcctaatgttgagtccaactgatgcttgtgtgattttctggctctctgtctatcagctcctccctctgttcacagcagacactctgaggtctagctcaccctttgtgttaagtgttaactcttttgtaaaagttctcaagctcctctccatgcactcctagtctgtaacatgaagtagccctggattctagtcatttttggggagtatgccgtctgcctcatgacaattttatttttggcttcccaagttccttaaaagaacattgatggcagagatcctagctcattttccctccacctaaaagagctctctctcaacccataacacttacaagatgtgagcaggtaacctcggggatgacaaatactactgtttgccacgatctccaatctaagaggtttgtggaaatacatttttttcacatctgtgtattatttccctatttgctttatttaaatacttggacacattttcctctttgaaaaatatttgactatcttctgcttccccacattacttaggtttgtttatgtctactagaaatttgatagacaataaaaaacatttattgagcacctagtatatcctgagaaaaatgctgattagggttgaccataccagatgaagtttgcacaggcaacattatctcataaggtggattctgttatcaacagagtgatctgggggccttacgtgaggccagattgtcagggacggctctaatttggcaagtcaaatccgagaggactgagagagacatacttatttttttgagcatttctaggacatttcactccctagagataaacccacgtgtgacatccacttcctggttctccttgctccaaagcacgtggctcttctagactctggaggcttttgccatcacaaatgaaaacgaaggcagatgctatcagtcagaagcaagaagagaaaggtgtgaggacaacatgagagggtgccgcagggactgtccctgtccaggtaaaggctctatggagggcatagaagatacatggcaccctgcagggcaggacattctgaacaccatgaaagcaacattataggtgagaggggccctgaaggatgcctggaggagggctgggggacacatgcctggtgtgggggtggtaagaggtcactctgaagtgggaggatgatggcaagaagaccatgaccatgtgtgaggttattagtgttcaccatgatgtggggtgggtgatatctagccctaagccagattctcggggcaactcagcctcagcctcctgagtagctgggattacaggtgcctgttaccacgcctggctaatttttgtagttgttttttagtagagatggggtttcaccacgttggccaggcttgttttcataattttatactaacatttatttatattcatagaaaatattttatattaatctactttaatatttttgtccagtgcatttaagatattgaaacagaggtccaggaagattagcttgcctgtggtctcagagccagtaagtaaaggaaccaggccagtgagggctccacagagcagccccattctgtcttggcctcaccatggactcctgtggctggaggttgaaagcaaaggggactaggtgaattctgaactgtggcagtttcagtgagaagaggactgctgggacactgggtggatgctaacagacactgggggaaacctttatctggggatgccagtgaaggggaataataggagtcacctcttagacaagtgttggcaaaggagatgggaggatttcaggtttctgagactaacttctcttctcaagagggttatatccttattgttgatcttggcccttgtcaaaatcttctggggaagaattctttttacctccagggctcaccatgacagaactatgtaaaggaagtagctgtctgggttaggtctgggtaggagcgaacatcgctgaagattcgcctggcagagcgggcaaacctactggtgctgttggatgctggtggaagatccaagctcagctgcctgttctcagaatcaggtggctgaaatgtggttcctgggactgagttttggcaaggcaactgtgccttctggatgtgcacacatgcatacatgtgcctgtctagctacaatttcaaagtgacagcaaacaaacaagagtagccatcagacccaacgctggctgagctgctaggagatacaatgcaggtagtatatgcatctaaacttctggttcttaggaatggaagtttaaatgtggagtgcagatggtgatgctggtcaaagtgaggaagtgatttatcttctggacagctgccttggcttccagatctcactagaatgggcaggtcttttctagaggtctgtgacatacaattttaggggaaaaaatagaaagtaaatcgccactaataagtgctaagttcgaaaagtgccagttgacttgtctttccagatagttccagccttggtggaatttaatgcagaagagatgacatgtcagagtgactggagcatgaggcgatcgtatgcacacgatgaagctttgcataaaggtgatactgacgtagctccttatcacagcctagactatttaggttctgcttggacaatggatcaagtttcctagcacaaaaaagacctgtgtgcgcagaaaccgctgcttcgtggtccaatccctccaccagatgaaagcactaagtactgcaggttccatcatgactctgtggcctgctcatctgggctttggtcattcacatgttcctggaactcatctcacagggcaatttcaatgcaggccagaccttgagcaaggccaagatggcgatgtccattaatggctttcatctttggctcagcaggtggatactgggattagtcatttcctattttgttcagtttgccaaatacattctggacctttaaaaagtccttatgctatcgcaatatgatgctttggtagagtcctgtccactttccactggccttggcaggtggttgagtaatatgaaagcaactagcgcctaaattgtgaaatacaaatgttactttgtttttgtagaaagaccagatgaaaataacacaaaatgttttggtatttttgttaaaaatgcaatctgggcttgaagaacttaaatctaagtctggctttatgtttcatttaaacctttttttacttaggcaaaatagcaatatttgaaggtaaaaacaggtttgtaatgattaggaaagattctcctaatttcttaattgcactttgcaaaccaattatacaagagaaagctgaaccagttctgaatgtgttattattgttatcaggatttttacctctcaagtgaacagtgctttacgatttatatgtgaaagtgctttcgcatgtaatgtataataatcacacagtcttctttgaaatgccttgaactttaagaacaaatccaggttgaaagaagaggtactcagagaaataatgtgaatcagatctctccagagaatcagatctctctactggaatccttgcgtgcagggttttctagcgtgcagatgaccatatctgggggcctaacattctagccactatctggtctgcttcttaaacatggtcttgttttaattaacacaaccttttggctgcagatctggtggggatggaattgggaagtgccaagggaccttgaatgatcacacatgatttttctccgtgtagaaacaacaggctaagagagtctcctgagaaaagctgggcttgtgagataaccagccctactcggagaagctttggaaaaagaaaaacaaaaactcaactttacaactgtatatctggaccaaacacctgagggactgtcggtaaatcctttactatatgacactgcccatgcctggaaatgagggatagcgtatactccaaggaacaacatctcttgtagggtttcacttcctgaaaagctactgaagaaaaaaaccattgaagtcatgggacaaagggctattcctctgagttaaataacaatgtcccctggagggagaattccacttcttctgccaaccagcaaccctgctggcagctgtgtttgagaaaagcgtgcctatcaactaatgatgcctaacccctctcctggctcctgaatggagagtctgtgttggtggtattgatacccaccattaacaaaaacttcgcttactttcaaaaatgtagatccttttatgaattcttcatcataacaaaggcaatggtttcccatttttgtcttaattgtatgtttgcccaaatttgatggatcatgttttggtttttatataattttctttttccagatttccatttagggtcctcaggctgaaactaggcatatcccatggcccaggctggttggacacaactaaatctacataaatctccattgagtctccgaggagattcgatgagaaaatattttaggaaacagcgttatgagtctctgtgctcagtgatatttaagttggctgaccatttcaattttggaaattatagtccattaacatgaaaaaaaggcaattacatgtttgtatatttctacctatgcttgtgctttttgcaaatgtttataaagagtggcatgataaaataaaataattttgtgtttgcttctggtgacagtaaaattttatttataaaatacaattactggccaggctcgctggcttatgcctataatgctaacactttggaaggccaaggcagggggatcacctgaggtcagaagtttgagaccatcctggccaacgcggtgaaaccccgtctctactaaaaatgcaaaaaatagctgggcatggtggcacacacttgtagtcccaactactcaggaggctgaggcaggagaatcgcttgaacccgggaggcggaggttgcagtgggccaagatcgcgccactgaacttcagcctggcaacagaacaagactctgtctcaaaaaaaaaaaaggcaattacttaactaaaagctttaggatggttaaacaaacaaaccaacccttctgctgaacatttgagtttcactgattatgatgggaggttcaaatatatgattacttcatatacggatatgaaaaaggtctgataggcagttttcaattagagttattgttctgtttccatattaatagaaaccaattagttattatgaacagattgggtatttagctcaggtacaacataaaatgcaagactaaaaagaaaaacgaacatacagtattctttttttctgtgttgctatgaggtttaatatatttaatatatactttttgtatggtccattggggcaagggatttcctggcattgaaaatttactcaaaatatctgtggttaagttatcataacgaatattactaatgtctaattcattaagaccaacaagccagcatcttacatgatgtttggtacttagtaggtatttgagactatactcagttttttgcaaaaactgtctagctcttgtttgcctacaaataacattgacaatacagttcatttctaatgtaggagaaacttcattttggagccttgcccctcaaacctggtcctgattactgcttcaactcctgtttatataattctacacaattttggcaggattcaagagcacataccagggtgttggcttttatgaatctcctgggatgtgaatgtcacgctgactggatgaaccctggccacaaatcccagacaagcacaatgattctatttattcagacttggctgcctgaatgcagattgactctgtgggtaataaattttcacaggccaagagcgtcaggatcaaccaagctgatcctgagaagaaaaatgcaactaaggaagtagagttgggctgcaaaaacctcctatgtttttattccatgtctgcatatcattcagctaattcatttagttactgattgacatgtactgtcaatgctttcagacattttaaaagctctgctttgtgttatgcaattgtcatattaaaaagaaacaagggaaaaaatgaagagcttccattacaattggcaatctgcttttaagagtacacccaaaactgatgtgagtcatccagtaatctctgtggtaaagagcacagaattgagatgggaatgtttcttgtgctgctccataggaaaccaaaggaaacagcaataagaactgcaattttgtgctcagagcaacctcacctacaatcttggtatcttgatgaagcaaggctttacattatttctaagagacacgactattactctatgcattataaataagaaaataattggctctttaatttgcagatttatgttaatgatctagatatctattaaattaattgcatgctctccaaatattgattggggattaaaaggcagcttttcattgtgcaagaagtaaattaacgccaatggggaaatttccctctacagattagatccaatgattgttgtctgtaaaattaaaatagtcagttaaaggggataaaccatgttcatttaaagagaaaaatgtggcaacagagttaaaataaaaagactgcccaatatgtttggataacgtaattactggaagctgcaggcatgtacatagccattcaatttagatccctggtcccttcctctccctaagctatgtatttgtcatctccgaaacacttgtctgcagttgacactatctcagctgctccttgctgaaagtcttaatcatgtgtccctgtcctcatgccttagctatagtaatgccatctacttatttgcttgtgtccaacctcccaagcttaccctgacttgagaggcagagctcatctttttgccaaatgggaagacatgcaatataattaatcagtcccttcctaatctattaaatttttttaatacttactgtcttaagtcttctaattccttcacattgtttcacaaaaacattggtctttggaattgttaaaaccaacagttacagaaaggagatcaaacaaattactccaggtatcacatacctttcatttactcagattaaataagaaagctgattctcagatattttgtgctatttccagttggaacctcatccagtgtgaaaatcataggtgcaaccataaggctatgcttccatttcatttatgtttgtaaactttctaaggaaacctggtcacaaccccagcactagaggctacagccaaaatttggttattcttgaaagggaaggctgtggagaaactcagtctcttggttttgaagacttctgtttgagataacttatgaaaacttgtagtttcaatatagcttgatgtaagcatccttaagaaggggctatagacatttccatggagatcggataaatgccttttttctcaaataggttatttgtgtattaatctatagccaatttaagatattgggccttatatttttgtcatctctgtcaatacttttgatgtttggacagaactcatttgaaaaatcatagagttcaggaaaaggaacaaaggcagagcaaaggtcatctttgatattgtacaatggacagtgggaaatactctcaattgaaggcatcactatgcatttatccacgcattcgttcaacaaatatttagcagttctgctgtgccagacacagtccctgccctcaggaaacttccagtttagctggtgtagacagatcttagaaaaagtaaacataacatataactaaaattacgatgagattcaggtaaaaagatgaaggatactgtgagacggactaactgggagttgattagataagagggaggtctccctgaggaagtgaaagttatgctgtgcctccaacatgagtaggtgttagcaaggcaaaagtgagggagtagaggcctatggaggccctaaggcagcagagctcagcttcctgcaggagctgggagaagggccgggccacaaatgagctcagtgtgaagatgagacgtggacaaagccagatggtgcagggtagtgtcggccatgctgagggctccgaatttgatcccgggtgggatgggaaacctatttaagattttagaccaaggaattacttgatctgatttttaaaagatcactgtggggaggctgtattacagagggcaggaaatagaaatacaatagtttataccagactggttttgactagctgggaatggaaagaggtagatggaccaatatttaattttggaggctgagtttataggacttagagatgaagtgactacctgagtgaggaacagggaatcatcaaggatgagtctgaagtttctaggctggaacagctgggcatctggcagtgctagttttggaaatgggaacaataacaagacgaacatgtttgtgtgtctgggtagtgatggcaaaggccagaagtccagttgggcacagactgaatctgaaatgtctgtgagacatccaagtggaaaagtaaagtaggtttgcggttcagaagagagttctgagctggggatataactttagaaattgtcagtatataaaaattgaaggtcataggaatgggtgagatcacccagagagcagacatggagaagaaaagtcaggaataaacatggaaagtttccaacattgggcagaaaatcagagtcagcaaaagagcctgagaagagaagccagaggggcaggacccaaaccaggagagtgtggtgttagactcctacagagaagtgggtgatgaacagtgttcaatgctgtaagtcttctagtaagacaggggactgaaaagagcccagtataattggctctacagaggtcattgggggcccaatgaggagcatttctggtaaagagatggggtcataatgagatcaaaagaacaagtctctatgtagctctgaggaaatggatgaactttggataggagcagggcagtgtcctctcacaacaggaggacacaggatgagtgaagatggaagcagtggtgcagatgtggtattgagaagtttaggtttctctgctagaagccagtcagccatggtatgaggtagggaaataaagatgaataagatacacggtgaaattcaggttgtttacttatgaagttgggaagacagaaaactacatttgtatcacctattattattcattctgtaacaaaggtaattataggatattaagggagaaagcatgcaaaatgacagtaccagcgaactgttataagttatgtatatatagtgtaatacctagaatagccactaaaaaagctgtacaaagagatacacataaaaatgttacagacaaatcaaaacagaattcaaaaggtttaaggaatacacagaaaggcaggaaaaagaaaattaaaaccaggaagaaactaaacaaaaaatagagtggtagacttaagctttaacaaatcaataattacattaaatgtaaatggtctaaatgtatcaattaaaacacagaaattggcaaagtgaataaaaatatgacaactattaatttatgctgtatataagaaactcatttcaaatataaccatattggtaggctgaaagtaaaagaatggaaaaaagttacattatgaaagcattaatcaaaataaagcaggagtagctgtgctgttatcagaaaaagtagacctcagagcaaagaaaatgaccagagacagagtgggacattacataatgatagaagggtcaatctaagaaaatatagcaatcctaaatgtacacacaccaactaacagagctgtgaaatatgtgaaaacaacccgattgaatagaaagaagaaataaacaaatccacaatgacagccagagacttcaacacctctctctcaacattagatagagcaatgagacagaaagtccagaaaagatacaaaagaacatcaaataagattaattgatattaatagaacaccctacccaacaacagcagaatacacattcttttaagtgcctataaaacatataccaatacaaaccatatcttgggtcataaaaaatcctcaacaaatgtataagaattgaagtcatacagactatgttctctgaccataaaggaaccaaactagaaaccaataaaagttaagattaagggcgatctctgagcacttaaaaattaaacaacacatttctaaataatccatgagtcaaagaagtcttactgaactgaatgacgatgaaatacaacacatcaatatttgtgggataaagtttatagcattgctgagagtcaaatgtatagcactaaatacttatatcataaaaaagaacgaatctcaaatcaataatctaatctccctcaagaaactagaaaatgggcaaaaatgtacccaaagcaagcaagaggagggaaataaagataagaaatcagtgaaactgaaacagaaaaaacaaatagataatattaatgaaacaacaagctagttctttcaaaagatcaatacagttaataaacctctagcaagactgatataaaaaagaaagaagacaaatgatgagtatcactaatgaaacgggctgacactatagatcttgcagtcatcaaaaggataataaaggaatattataaacaaccctatccacataaacatgacaacttaagtgacacggatagacttattactgaagaacagtgtaccacttatacccagtatgaaacagataatctaatagccctatgactattagataatctgagtagctctataactattaatattttttttttggctgggcgtggtggctcacacctgtaatcccagcactttgggaggccgaggcgggtagatcatgaggtcaggagatcgagaccatcctggctaacacagtgaaaccccgtctctactaaaaaaatataaaaaattagccaggcatggtggtgggcgcctgtagtcccagctactcaggaggctgaggcaggcgaatggcgtgaacccaggaggcagagcttgcagtgagccaagactgcgccactgcactccagcctgggtgacacagtgagactccatctcccaaaaaaaaaaatttgtttttgtttttctccccgagatggagtcatgctgtcacccgggctggagtgcagtggcttgatcatagctcacggcaatctcagcctcttgggttcaagcaatactcccgtctcagcctcccgagtagctgggattacacgtgcacaccactatgcccaactaatttttgtatttttagtagagactggttttcactatgttggccaggctggtctcgaactcctgacctcatgatctgctctcctcagcctcccaaagtgctgggattacaggcatgagccaccacaccccgccgggaaatagaatttttaagtttaaaaatctccaggcccatatggttttactagagaattctgctaaataattatcatctttttgtttttgtttttgttttgtttttttttcgagaaggaatctcactctgtcacccaggctggagtgtagtggcacaattttggctcactgcaacctccgcctcccaggttcaagcgattctcctgcctcagcatcctaagtagctaggattacaggcacatgcaccacgcctggctaatttttgtatttttggtagagagggggtttcttcatgttggtcaggctggtcttgaactcctgacctcagatgatccacctgccttggcctcccaaagtgctgggattacaggcctgagccactgtggccgacctaacatcattttttaaaagcataatctttttgagaaaagggcaggggacccttcttaattcattttataagatcagtattaccctgatatcaaaactagccaaagacagtataaaacagaaaacttccaactaatatccctcatgaacattaaaaagacaaatgtgtggtgaggatgtagagcaactgaaattctcttacactgctggtgggactttcgactggtacaaccattttggaaaatggtttgagataatttactaaagttgaacatgcacataccctactgctcagcatttatacttctgggcatagatccaacaaaaatgttcccatgtgctcaacaaaagacctgtacaaggatgaaaagacctgtacaaggataaaaagacctgtacaaggatgctgataagagcacactattctactccccgacccctgccaaaatatccacatgcccattagcagtggaatgaataagtaaattatggcatacacacataatgaaataggatacagcaatgaaaatgaacaaacttcaattacaggtaacaacatgggtgactctcataaacaatgttgaatgaaagaagcaagacacaaagagtacatgccgaataattccattgatacaaagtgcaaaaataagcaaaattacactatggtgttagaaaacaggaaagtggttattcttctgcagagtggtgactggtgggagcatgggggcacctgggtcatgtctgtattttcatctggatattggttatgtcatacacatataaaatcatttttaaagacatatcatttttataaatcatatacaaacaggctgggcacagttgctcacacctgtaatcccagcactttgggaggccgaggcgggtggatcacttgaggtcagaattttgagaccactctggccaacatggtgaaaccccgtctctagtgaaaatacaaaaattacctgtaatcccagctacttaggaggccgaggcagcagaatcacttgaacctgggaggcggaggttgcagtgagccaaggtcatgccactgcactccagcctgggcgacaagagtgaaactccgtacacacacaaaatatgcctattggatctggtgacacgaagatgatgggtgacctcaaatttcgatgaagtggcagcttggggatctagcattaattccaattttacaaacagagacactgaagcagagaacagttcagaggctgggccaaggttgcaaaactaagtagcagagtggggatttgaacccttgaagtggggccgctgtgctcttaaccactaaactagactgtcttttgaccttcaggatcacaaaggcaatggggagaaaaggaaacctcagataggagtgttcaaaagcatggagtctgaggcgatctgaggaagggcaggcaggtatagcaacttgaagctcttgtagacacctctttattacagtggcacatgggctggttgaaccaatattcacaaagacagccagatataatgtcagaaaaggttaaggatttttcatacactgtagtgtttactgaggcaagggatttttaaaatattttgggtttacggtgcaaactctgattacatctagaaaaatcatttatgttaaatgttcaattatctcagaatgccagggaatgagtgtatgtgtctgtgtgtgtgtgtgtgtgtgttcgtgcaccggctatgctgcttccgggataaagcatagtttggtcttgaagagaaaaaaataccatatcattagtcttgtttaaaagtatgggaattacaactttgtgattagaccaggttataattataggccaaagcaggacaacttaatgcaattactgttgaagcaataacttaaactatcatacgcaaaaccactgtctggagtcttaattaggaaaaagggattaatgtataaaaattattcattctgtcagttccttttattgcaaaaataggaaggtatattcacataggaattaaatgcaagaataaaggatctgacctgtacattcataacacaatattatcaatgagtacagaatggaagggggtagcttaaaaagcaaaatgagtcaactaaaagctcttactgccttagagaacatgtatagtacgtcattagtaatgtttattaaaattgagttttcattggaaatacttcctggaaatagctcaggaaattatttccaaatttaaaaaggtttgcagattgaaatagtctgtgaaccctttttctaataaaaagcatacacaatttacatgtttgatatgatttaatccataatctatgtatccaggccacttaatgggaaaaaacacaaagagttgaaatcatttgcttatcatcatgtagataagaagccaaaattaggagtgaagtcattctacatttctgctaagattgctgtgtggcagatatctggctgccctggaaacaaatcaacagatctgtaaaacactcgaagcctgagtggccttctttgcccagttaaccttcttccactgggtattctccacctgccaatctggtttccagactcctcaagctcttctccctttttcgtgcctcagtttctcccatgacatgagtaacctcttctgtgacctcatagctatgctctgctcactcttcctcgaaattctcctttgacttttatttaacctctgcttgttctctctgtaagttatttgtatttgcatgtctagacagcaaatcatctgcatagcatttcatgatacctttctattaattcactattccaaaaccaacagaacagcattattattttgtactgcatacaaaaatgacttattaaaaaaagcctctctgaattgtctttctacccatcacatgtatctaaacttgacaaaatacaacataggggatgagaaaaagaaaacagaagtgtagaaaaatctgtctttagtgtttttaaacttgctttgaaatacaaacatttcttgaaatgcagaagtgaaagtgatgaatgttaagtggatattttttcaccttaactgactgatcagaagagtatttataaccccctaactgatgtctcgagctgataaatcaacaccaggggagaatatttcaagcacatttatcatttaagacaaacagcctatactgagcataattactttttattcatcattttggctcacctctacatttgctccttctcaatgttaataatatctgtgtaagacttctcaatatttaatgttacggattgcctgttgcatgctgatgaggttaaggtcatatgtttgatctccagaaggccagttagcttctcacacacacacacacacacacacacacacacacacacacacacacacacacacatgaataaataaaaaagaaaaaaaaaaggctctgtctacttctgagggaagcctgatcttagcttccttgtaatacccattgctggtctcaatatcataaaaaattacagaattcaaggcttaagggaaattatgggcaagctattttaatatactgacccaactgcatagaagctcacacttagcagacaaaagaccagcagcctggagtgccaccattcagcttggttaacacccggcacagtccaccaggtaactgttaccagtgtcacctccaaaggatgatgacataaaagagaatcttacctgttcattctcctcttcatcactgcttagcttaaggtcatcttccagcattctgaaagaaggaacaaagaggtacaaagaggtacagatagttagtggattcagaataattcagcaccaaaatatcaccttaatgttgttattagagcaacattttggaaataagtctatttgatttcctattttttttctttccttcttatgcacttttcctctggtgcacttaggaaatagtagacagccccatcataaaaattaaccctcacaacagtcatcagctaagacgggcagctttcagaagatgctgtgttagcagggaaataatacttaacaataacgtattgtatatttcgaaatagctagaagggaagaattggaatgttcccaacaggaagaaaagataaatatttgaggtgacgaatatcctagttaccctgatttgatcattacacattgaatccctgtatcaaaatatcacacgtacctgaaaatagcaataaaaaagaagatgctttttttttttttctctcaaatacataggggcttttcccctgggcagtttgcattccacaattacttgtttagtgttttccaagctcccagtgctgggctgtgtctccgtgcctgccccaggggctttcatggtaaagagagatgagaaaaagagccataaagccataaacttgagttgtgagcgaagcttcttaggccatccatcagtcaaagagctggaaaagatgttgtccccaagatcctacctagtggggaaaaccaagcaggagggcgctttctgaaaagcctgtgaaggtgattccccagcccacccaggtccccccattcatcctgaggagacagcggggaagcacgaggttaaaagtgaaaaaaagaaacagaacttcagactctgttatttgttatgataacactgtattcttttcagcatggctaaatttttctttatagtagttttcagattaattcatttcaaaagaaatcttactcagaagtgcactgtataaaagcgtgctctccacgcagagacgctctgagggagcaggggagagcccacttctgagggaccctggggctccatacatcagtgtgaagcccgctgagcccttgtgctcaaaggcctcattgaagccagcttccaaaggctgtcccctaaaatgtacctagtgtcctttaaaagccggttgtaggcctatcactgatacatgcctctgaacattcgtaggagtcatttcagtcacttttggggcgaactggggggtaaagaactggcaggataaggcatggcccaggctctgccccacctgtctatgcatgtggggtgagtcgcttcacgcaccctgaccccatttccctatttgtgcagtgacgtgttatagagggcaatcctaaggttgaatcctgctttagattccgttgtgagtctacaaaataaatatgctccccagtttcgtcaaggagaaaaacccttctatttgctctagagaatacaacggagaaacttctaagtagtttttagggtactatttaaggcattgccatcagggcaccaaatctgcttcctcacaggctcctgctcatctcccagtgccgagaggtgtcgttcttctattatttaaaccacaagtgaacaaatgaacacgtcagcagaggctgtaaagcggcacccccaattcctctgcatgtctggcacgccattcatttccttcacctcacagacacatacgcttggcttcaaagagaagagacctcttggtgatttattagagcactgtttgggagtagcctagggaagtgggctgtgtttcctttgtccttgagtccccagtgaccagcacagtgcggcacagaacacaacgccagtttgctggctgggatgaggccccttccccaagactgttttcctacccaaaggcacagatttcttcctaatgaaaaagaccagagaaggggacaggtccttgcctccactcccatgccctcttttgggtaaaccaccactgcagtgtggtttaatctctaggactgcccagcaagcactgggtctttaaagggtgggtggtcctgctggtgggggtggaaagagtggggaggactcacacaatcatggttaacaacccccttgctgtcagatggaggctgtgtggctgggaaatttaatgtttaaatggacaatactgtgcgtggattggaaggccatcatcccccagagcaggaaagcccaacatggcccgaagtgagggagcttgggttggctgcaaactagccgtgcaactcagtcaccacatgagcctggcatggctgaaagtcaccacaacggtcaaaatgctgctgtgtgaggctctctttcaaggtagggaatgcagcttacttctgtttatttcaaacatgtgctaaacgcgtccacacgtaaacacgcatctgtttgaatctcagagccccttgcaccacaatcttgtgtgaggtgcacctctggggctgagcatttgtgcttctataatgagactcatctatctcatcatcatttccagaagaaaagcagtcagagttcaaccttgctttgtgaataatcatcactctgtcactgactttacctctcttatattaaaaaaatgaatttattgtgtttccggctgggttctaaatacaacaaatcacatgtaaaaatacactgccttcaagagagacttcaagagaagttcaaatctaactaaacttcagaatatttcgaaatatgagaaagtggccatggaaacacaaactcacacagcttatacaacattcccggagcaatcctgggtgatgctattcccaaaacatgaaatcacagacctgggagagacgaccacggccataccgcatcccagccccgacaggcacagaggtacaccctgaggagacccaggctccccgcggtctgagagcaggaaccctttgctttattctgatggtcatgagcaggcccttggctcaactccctagcaaacggcgcttgttcttgtctgtgaccactgcatcttcaagtccggtttaacattcacaaacaactccatgttgaatgctgaacatatccaagtggcctcttagagagcctaaggaggggctgaagtttatagctgaacaatgaaacatggttaggagaagagaaaacccgtgacactcacaggatcataggaactgtctgtacttggtgtatggccagcagacagcaggcatggccgccttcaccaaacacacaaatggcaccgtggtggtcatgggcccaacccactcccaaaccctggggaacatttttatcatttgtctgtttccctgtggaaacataggtatatcaaacaataaataaacaaacaaaagtgttcaaccaagagtaaaaggaagatgcaaattaagtgctgattaggctactggggaggggtggagatctcctactgtttttttttttttttaaagggaaggcaaagaccctgctgctctaaggggctcctgagggctaagtcatctgcacggaaggactagccatctgcatggaagcacagggcctgtgcatccatccacagcaccctggttacacccctactcctgggttcctccaggccctaccccagctgatggggcccccaaccagggccacccctttcacgttcccttagcccctccccttcatagctcttcagatccctcccaggggatgaagccctcaactcacagcagcagctctcattgtttaagggatgtccgtccgtagcagaccagctaagtactttctagatgttactttgtcaatccctgcagcaactcctccaaggtgggaggtgggtgctacagggggctgtggaccgtggtagtcagagcagggactccagcgtcacactgcccaggaagaatgctagctctgcctttcatctagcccagggccctgggacctgcctcagagggcttcctggagaacttactccacaatccttggatagtgctaagcacgggaccttacgccagggagcctccaatcaatgctcatttttatcaatgctcatttttaccaatattcccttttccctaggagggaagtgggcctcagagcatttaagaaactcatgtggataaacaagttgagactttgagatgtctttgtaatgatgccttaaaacagggccatttgctctattttcaggccattttgaaaagaaagggtcatgttcctgagagatggtggaggggaatatattttggcctgtaactgctgtcagctggtctgagtggctttatgtcgacaggacagtaaacacgcctatcagccccagtgcacggagaggtctgccctgggagctagcgggtggccacgaggccaggagtccctccacgaggagccaagggggtgttgccagatgacaatggggaagttgaaataaaataggtactaaaattgaactttttggctgcacgcggtggcttgttcctgtaatcccagtattttgggaggccaaggctggcggatcattgagcccaagagttcgagatcagcccgggcaatatagcaaaatactgtctctataaaaaatatataaaaattagacagacatggtggtatggacctgtaaacccagctactagggaggctgaggtaggaggatcacctgagccctggaggtcaaggctagagtgagccgaggttgtaccactgcactccagcctgggcataagaccctgtctcaaaaaaaaaaaaaaaaaaaaattgaactttttgaattgagaacagacctggacttcatggccttaacacttgaagagttatcaaactactgtcagggatactccacgttagcacctcatggtgactttacagtagagtctgaaccagctacatgagaactgtgacactttaaggacagaagcaagattttttttaacgtgcgattaagcgattgagattccacctatttttacttgggaacttgtccttacaatgattgttgggcatgttgtaacacccttcctgacacgcagacaaggagtcgaagggttatgagcccccagctgcactcgctcacgctttcatgcagggagagcgggccttgcaggagctccgtagaggaaaggacacaatgggactttcattcagaactctaaagagggagccaaagataaacaggcccatttgcagtttgccgagcactaccctggaggacctttttctttctgaaagggaaagatgaatggaaacatgcctcatcaccaccagcggaaccagtatccaaactcccaattgttgttttgttttgttttagagacagggtcttgctctgtcatctaggctggagtgcagtggcccaatcatagctcactgcagccttgaactcctaggctcaagcaatcgtcccacctcagcctcccatgtatctgggactacagacgccggctaccacgcctggccaaacccccaactgttgactcattcaattacttctgtgtccactgtgtggcaggcacctatccacagaaggtgtactgtctcccaggggtggttcccctcacacacgacattcaaatcagcattgtcattttacgtatttttaaatgccttcgaattgtgaagctctggcaaatacaacttttgcagaacccaactgtgtcatttgaaggtaaactcagtacttttcagaaaagggagtaattcagtacaacctttgcaattttaacatttgattaccataacttccctgtgtgtattgttttcttaattgagcaagtgataaatttatgttgtagctggcgcctgcatttttgaggcctaaaatttcttgggaagcagaaatagcagcctacacttaacagatggccaactgcttccaaagctcatctatatcttccacaggtattgcaaacgggcacgttaactacctgcaaatgtaatggcagccatttcacagagtagtggtttttaattaataggattttccctgaattagttgtcatttggggcccttaacagatcggaatcctttagtcctttaaagtcatttcattttgctttgttttaatggttttttaaaaaatctgagttttaattgggctgtttgattttcagatttgtttctatagctggtgctgctactatctccacctacgtgagatttaaagcctaagacaaatgtttatgaatctccattaaacatattcatatatgcaaatgtctattctaacaattagcattgcctgagagcctattcattatgcaagtgcatctctctgcagttattccccaagccatcatctccactgcttggaacacgggagggaaagttatacaactcatttcattctttctgaagtctactgctttgtcagggtcagtgctaccatctgcctgtggttattttcattaacaagtaaccaccttcttctcagcgtttgttcggaagaacttagctcatgccatcccagctaactgggaacagggaaggctagcatgggctcactctaggggttggcaatttagtgcatccaaggcacaggtgaactcacttagtctggaggcaaatggagaaatcaggaacaagatgaaggggtgctctacttgacctaagtgtttccaactctgatgttttaaaacccagggatctctacatcttttgaagcaattttggtccatagcaaggtggtatttgctcacacatatctccttcctggactccctccctcccggggagggattgtcagtgaaatcatccatgatcctgtaactctgccatgttgaacctggggtgaaggtgcactgtctcgcttaagtttatgaccttatttttagttagggacagcaacttctgatggtccttttctccactgacatgctgaatccacttgccaccttctctgcaggcccatcttccctgggggacggcatctcatctcctaccctagaagaacctcacaaaagccagtctcatttgggaaacctgccaaatcctggtgagatgctggatgatgtgtgtcttcaaaatctcaatcagtcaactgtctttcccaacagtaagcatatctatagtaatagaaaataagcagaaataaaaggaaaatggaaatcaacagtcataagaagaaacagtcagtggtacagagtctggggtggtgaaataaattttgaaatggcagcttggaggctagccagcattagcctgaattctgtccctaactagctctgtgaacttaggcaaatcacccacttcccctagacattgtttccacatctccaaagtgagagttggataaaacaaccactatatatcctcttattggtctgaattccttggttctgtgcctttaccaatgggtagaatgtccaggaagactgctggagaatgagatgatctgatactactcagcacattctaggtgctagagatataaaactggagaagtcttccttttcaagtgtctcactgtttactgggagcagcagcagttccttgaacatcccatgatgctttccagctagaaatatgtaagtgccacacacggtttgtgtgattgtgaaaatataaaaatgctccatcttttccacttagggcaatctaggccacagttatgaagtagcattctccaaatatattagactttaaaattgcttcctcctaaaagaattacagggaaagagggctggatatactctatcatttctatcaaaaaactgaggctttagaaagagcactttaacccggagtgctttctccctgaagatgggtttaaatcctgtctttgtctgttttaaggacttctagaaaattagtttctgagctcgatgttctcagtattaaagaattgagtttctaaggctaaatgaatgcaagtagtgtgtgaaagaacatgatcctttcccgggcagacagcagaggacaggtcagaggattctgactgggaacataaagtttctgtggctgtacagatttggtggtggacattacttaaacctctttgaagggggatgtgcacctaaccagaggggaaatgagatatgtacgtatttatatggctcaaatctgatgttgaatattgataatcagtaaataagtaagttagctgcctattctgtttgctagctaatggtgtgcttatttaataacttctgacaataagaatgcattgaatctgtaagggtcataacatacatcaggttaagatttgttctttggttggaaacatcagtttttgcatttttatggctgctgttattgataagttaattgctaaaagagtccctaattaagagatttgaacagataaactgttagaattagaaaagagaaccaagcataatctcctaattagcaaatccatgcactttaagctataccagcgttcacacattacctgaggatggcataacacagtggtttccaaactttattgcacattggcatcacttgggaatctttaaaaattattgatgcccagctccactccaaccccatattctgacgggataggtttggggtgcaatctgggcatcaggtttttttttcttttctttttttaaagctccctagggagctgattcatgggcctcagccccagatattctgattcacagcaatgttgggacccactatataacacagagctggactgactcataagagctgaaggtcatgaatagctctgcaccttggatcaagtcccatactctaagttttagtttgttcattaatataaggggatgatagttgagattcaaatgagacaataaaggtgaaagcccattgtaaactgtaaagcttcataggagttttcagtaatgggtttagcattacctgggatgttttgaaagatactggtctatgggccttaccccctgggattctgatttaattggttttggattggccacaggcatcaggacttctgacaagctgctatggtctgaatgttccgtgttccctcaaaattcacatattgaaacctaaccttaaatgtgatagtattcagagatggggcctttgggaggtgattagctcatgatggcagagctttcatgaatgggattagtgcccctgtaagagagacctcaaagagctctttcgactttgtgtcctttccaccgtatgaggacccagctcgtaggtgctgttgatgaaccagaaagcagtttctcaacagacaccacatctcgttccttgatcttggactccccgtcccccagaactgtgaggaataaattactgtcattcagcagcttcccaatttattttgttactttagcctgaggtatttttttttttacagtagcctgaataaactaagacatgaacatcctaagtgaatcttctattcagccagggttgagaaccactgccttaattctattttttttttttttttgagacggagtctcgttctgtcatccaggctggagtgcaatggtgcatcttggctcactgcaacctctgcctcccgggttcaagcaatgctccctacctcagcctcctgagtagttgggactacaggtgcctgccaccacacccggctcatttttgtatttttagtagagacagggttttgccatgttgaccaggctggtctcgaactcctgacctcaggtgatctgcccgccttggcctcccaaagtgctgggattacaggtgtgagccaccacacctggccactgccttaattctaacggaactatcaccttcctattaaaatcatctccaatccataggacagaattagtcacttcttatctaagtgaataatttgtacataactaatgcattatgttggaattttctaacttatctggcttcactctccccccatcttccattggaataagaatgcttgaagggaaggggtgtgtttcctcaacgcctaggataaggcataagcccatcattactaaggaattaccacgaggcattttagaattcttcagtagttgttttgagaaaccacaaggcagcgctggggaatctgagattccagcttgttcttcagccttggggaggaaacagaaaattttatgaatgccacacctttcaagctccctggagaagtccccacactttcgtcaagactgcataggatagtgtgctgggttttctgtctagtggcaacttggcatcatctcccctttgaagcactcctttctatcacaggggctggaggcctgggaactacatttccccagaatccctgccgatagggtttttggttaaatgttgccagtgagaggcacctgaatagggcttggaaaatcaaagattaacagaagcctttactactcccaggacagtgaagcaggtgcagaagcttcagcagatggcagatacgaggttctgtgagtggcttccaggcacccttctgtgaataatgcctgctggagacatctgagattactgttagcagttttctgttattcttgcatttattgatttcttgaaatgactttctgaactgatggctgatttcctgttggtcccccttccctggccctcctgatgggtttggaaggcactaattccctatgttaagtgtctacttgaaatacctagagtggtttctcttctccagatcaaactgactgatgtgtatagtaattaagagcatgagctctgcagtcagaaagcctggtttattgatttctatccagatgctgtacctcatgctagttgtgtccttatgcaaagaacttaaagttgctctgccttctgtttcctcatctgtaaaatggaaaaacgagagtgtttacctcctaggaatgttgtagaaaatgtagaaaacattttatacagtgtctggtatgtagtaattaataaatattcagtattctaactggaattttattacccattccatctcgtgacaacaactatgttacaatttaagtccatttttccttttctttttctttctttttttttgagacagagtctcactttgttgcccacgctggagtgcagtggtgtgatatcacagctcactgcagccttgacctcccaggctcaagtgatcctcctgcctcagccccccaagtagctggaactataggtggcccaccatgcctggctaatttttgtagggacgagaggttttgttatgttgcccaggctggtctcaaacccctgggctcaagtgatccacctgcctcagcctcccaaagtgctgggattatagccatttactttctctaacagagaagataaacttcttaatttctcgaccacctccgacgagcacattctaggtgccagagatataaaactgaagaagtcttccttttcaagtgtctcactgcttattgggagcagaagcagaaaagaaagccagcgaggtgataaatactatgggagcacagatgaccatcttttttccttgtcagacaatcccggcccttttatttttccttgtagttttattcttcagtctgtagttctcttctgtatctcctacaagttccccagtgtccttccaaatttatagtcacgtgtgggacacagtccactctacaggctctatcggcatggactgtagggggagaatgacccgctttatgttggaagtcaacagctctgagaattaaggcctaagactcataacttaaagctttctccacctaagctcatttagtctctccttccccaaatgtcttgaggaaaaaagccatctgcctccttgttcaggacagccatggggtcatttaagactcatcatggaattttaacaaccttatcctacgctgtgtggaccaagatgaccatctggctcctgtgattgcagtggggaccacattgtacctgggtattacagaggtgcagccatctcccctccccctgcagctgtccagttcctggaaaacgtgctcccaggaccttcagctgcttgtgactagatggaggctttcacactaatccactaatcctctctgccacaaacatcataagcagatcgtataaacgtgaagaggagaaaaagacttcaatgttccatattaaagaaaaagcatcctatgagctatttattggctggagattggtagatgatcctcacactaaggcatttccatgaattcatttttttttttttttgagacaggatctcactttgtcatccaggctggagtgcagtggtgtgatcacagctcactgtagcctcaacctcctggtttccagtgatcctcccacctcggcctcccaaagtgctgcgattacaggcctgagccaccgtgcccagcccatgaattcagctttaatactaccacttttgcagcactttgcatattttctctgatacttccagaatttttcattataaaatgaatccaggtggtttgaatatagaaatcaaataactctaatctcaaaaaaactcactatataccaggactttttctttctttcttttttttttttttggagactgagtcttgctttattgcccaggctgaggtgcagtggtgctatcttggctcaccacaacctccgcctcccatgttcaagtgactctcgtgcttcagcctcccaagtagctgggattacaggtgcccgccaccacacctggctaatttttgtaattttaatagagaccggttttcaccatggtgtggccaggctggtctcaaactactgacctcaagtgatctgcctgcctcagactcccaaagtgctgggattacaggcctgagccacccccctggcctttcttttttaaaaatagagttgaaaattaggccaagtatattgagagttctaaatccattgtcaggtacatacaactggcttttgcaatgagaaacctgattaccctgccaacatgcctctctatacaccaattacattctactgggagttgttcaactcatggtgacacagaatgtgtcaaataatccatgtaaattaagccttgccatatccattgcagaagaggggtgcatttactgggttggaagtggtgtcaccaggaccagtcaaggccactccttaagaaaggttcagcatttcgtcatggttttatatcaggtatatttcgagtttatataaaaaaagagtaaaactgcagaatcaagtcctttgttgccttcctaactttttaaacatattcatctatttctctttcagctggaagaaacgaatcttaagtgcaagaaaaaaaattcctgtgaaaaactctaagtgggaatgtacacttctgagataggatcagactacagaatcgtgttgcttctgcttagtgcttaagaaaataaccaggaaaataacgatctatttagttactatcctggaagtcatggtgtccatactgctaaagtgggtctattcactgatggaggacaggagagtagggataaaaacagacaggatccaggccgggcatggtggctcaaacctgtaatcccagtaggctgtgggaggcggaggcgggcggatcatgaggtcaggagatcgagaccatcctggctaacacagtgaaaccctgtctccactaaaaatacaaaaaaaattagccgggcttggtggtgggtgcctgtggtcccagctactcaggaggctgaagcaggagaatggcatgaacccaggaggtggaggttgctatgagccgagattgcgccactgcactccagcctgggcgacacagcgagactccatctaaaaaagaaagcagacaggatcccagtccaatgcagactttctgactttcctattttagatgagtcaagagtcctgatccacagtttcaattaaaatgacagaaagtcaactgatttcagagccaacaccaaataacactgtgaaggaagttgagtttacctttgaaaacccctaccacttcaggtgcacactccctctccaggactcatactcccatgtagactattcctttctgaccaaggaactggagctattctcatggtctggaatgggtctcctttcctgcctacttgctaaagtgtttctcttctcagtcccataccctttggattagttgtgagccagccatattgcatattgaagagttggtaagatttgactccttctaacaggttcccaagctctattgacctgtaattgcaaaaaaatacaaataaacaaaaccccaacagcaacaaagatcctgagggagtgacattaatggtagaatttttaaggtacagcggtagcccccaaatgggccatttttccttcgtctaatcttattgcatggcaaatatagacagcagcaggcattcctgactgagaaccctggtgatggcctgatggaagcagagatgagactgtctgatccactccaggcagcatggtccctaaagggccctctacagctgggagcctaccctgttctgtaataacagcacatcagcaacctctatcattgtggcaatggtaatcaattatttaagtcatatttcattgattgcctttatgtgccaggcatgttgccagccaatgcaaaccaatgatgaataagaaatggttcctcccttagggagctccagtctggaagggaactcaggctcactgaattttcttatccaggcaacaaactgtcccaggatcttttaaacagtttcctgagtgcaatgagtatgtaacattaaactcagaacaaagagaaggatctaggaatgcaatttcctatgtggccaagagatgtgttcctaccacaaacgtattcctggcttctgaggcactttgatcattgtcacccatgcagccatttttaatagtaaatagctaaatattcagaaataggcacttcacaattatttatttgatttgggtagtgtcaggctagggaaacactaccaggacaccaagacaagaagagaaatgtcccggtatggcaggggccagatgcgggagaaggaggaccagttttatcaaatgagccaggtgggtaatgggagtgagtgggagcttcaagtcatggagaacagacggagtgttctaagaactcagcgaggacactcttcaagccacgaggctgagctcctagaactctaggagacaggagctagaggagaggtgggctctcactggcctgtggaataaagaggctgatgaaccttcccaagcgagggtctcataagcagggaggaaagtatggggcttagagggagaatcaggctggtggccagtcagctgttgttatttataaatatgcttttatagtagttttagatttacagaaaagttaccaagagaacacagagggttctcgaatactccgtgtccagttttccttgtccttaggatctcacagcagaatgatacctttgtcacaatgaatacacctatattgctatgataacgtaagtccatttgaaatggagtcttgctgtcacccaggctggagtgcagcggcgtgatctcagcttactgcgacctccgcctcccaggttcaagctgttctcctgcctcagcttcctgagtagctggaactacaggtgcccgccaccacgcccggctaattttttgtatttttagtagagacagggtttcaccatgttagccaggatggtcttgatctcctgacctcgtgatccgcccgcctcggcctcccaaaatgctgggattacaggtgtgagccactgcgcccggccccagtcatttatttctatcagtatggactcttgcatgctttcttgctttggattataatccaatactagtcaactgttcctgaatcacatataaggtactacactatagtggtgcaggcactctgtacatacagcaaaggggcagaattaccatgtgctgcccatggtagtgatggacacaaatcaaaggcttatcattacctgtgcaaagtggttaaaattctggccaaaaagacattttcagtcccaacaatgcaatcagatgcttgaccagcaaaagcagtatactttccaaattataggtatctgcatatccacacatataccttaaaactactgggggcattcaattgccaaatcaaatggacaccttggtctccttgtcttgcttggtcactctgatttatgtgacatttcgtgtattccttcattgagctgttcttgtgcagcttctctgattctcgaggcgctctttcttttcctttgatgattctacccctttctggccacccttcagagctgctgtcaccctaggatccagcctcagttttcttctgaggtctctcatgtcctcatccactcccaaccatgacatccatgactgcttcctccaagtgccaccccctcaggccactgcgcctgggcatctctgcactgtggcttcctggaggctcgagctcatattttatctcacgggcatcttcagcatctaggaaaatgcccggcatgcaatcaccacacaatacatgtttgttgagccaataagttaatccctacttggatgtgcctccaccttgactggcctcaaaccagaacctattacctccccacctggaatccaacgagcacccacctggtcctctgcacgtgggttttgacttcctctctctcctccctacagacaacaaaactcctagcagtgtccatcttatttctcaagcttttcttggaattcctccctttctccatcccttgtgacgctgcttcggtttacatttcatttctcactggcataactaactcctctcttcagtcccttctccaggctctatttcccaccttgctgcagtccccctatgatttaaattcctaacactggctgcttcttagggtagacaaggctcttcatggttggcctcagctgactgcagctgctgcctggtcccagccctgtaactcaatactggaatgatgcaaagtctttatagttccacttctctgagtctcggcctgggctgcccttcctgcctgatgcccttctccctgttctcatttattactcactcctcaaagaccaccccaaagggcacagctttttggtgctcagtgaccttattgaattaccctctgctgtacccatgtctattagtgcacttgccactccacactggaatgattagtcttcatgtctgtctcatctgcctactcatgtgcttctcagttgacagtactgtctgagccttactcctttctgtatctccagtgccttggagacacaggtatttatttaattgcaaaaaaaaaaaaaaaaaaaaaaaaaaagagcattcaccccttcaaaataggagacaagacctgcaaagagcacagtcgatccacgactccaaatggaatggaatacatttaaaatacatctggagtgggcagaaaaagaaaaatgagctcaaaataagttataaaagcttactttaaaaaacaacacttagaggccaaggcaggtggatcacctgaggtcaggagttcgagaccagcatgaccaatatggtgagaccccatctctaccaaaaatacaaaaattagctgggcatgatggtatgtgcctgtagtcccagctacttgggaggctgggacaggagaattgcttgaacctgggaggtggaggttgcagtgagccgagatcacacgactgcactccagcctgggtgacagagcgagactctgtctcagaaaacaaacaaacccccccacccccaaaaaaaccccacaacacctaaatttataataaccacaatctttattattattattattattattattattattattattattatttgagacagtctcgctctgtcgcccaggctggagtgcagtggcgcgatctcggctcactgcaagctccgcctcccgggttcacgccattttcctgcctcagcctcccgagtagctgggactacaggcacccgccaccacgcccggctaatttttttgtatttttagtagagatggggtttcaccgtgttagccaggatggtctcgatctcctgacctcgtgatccgcccgcctcggcctcccaaagtgctgggattacaggcgtgagccaccacgctcggccaataaccacaatctttaaagttcattgtctattaactttaaaaacaaaggaatggttgggcagatttgtctattatggaatcagaccagcagcaggaagggctcaattggaaagtgctgagaatcccacggcttcgatcggttgtatgggtgcttatgaaataaaagttgcaagaatgagtgaacatgtactcctgttagaatccatgtacgactttttagccagagcttctcccagaaaaaatcagacttttcacaaatatattttggttaaaagtatactaacccaaggtaagaattttttttttttcaaaaaaagaaaatctaatgtgtattttgaagagtttatactcaggcatagtggagatcccttctttctgttttcttggtgggaaaggcagaagcagagaggtcaggagaaaggagatggggacggataacagcatggtgggcagtgccaggcatgctgggtgtgtttctgtttgaatgtccaggctgtgacaaagggaagtaaggaatgcatgttggagggacccatttctcatttgccctcatgtctagggcccagaggaccagtcacttaggacagctgaagccaagcaactgttgacatttctggccttgtctcctcttctccctcaccaaaatgatattagctgggacttcctcacctcctatccacaatgcattccctgttccagaaacatctcaggctgctggattaccaaggctggacccaaaccaggctgtgctcagtcactgctcattccgcccatgtggaggaaaaggttcaaggggatacttagagtctcatttgttcactgagggctccataataaagttctgctaaaaatgcatgttgctcctgaactcctgcagcctgcggtttgggacagagtgttattttggagcattcagagttgctgatgctattgtgcccttgtccccgcttggtgtccaaactggagcatttccttgctttcttagagctgccttcacttgaggccacaaaggactcgcactattaatgagcttgtgcaccagaccaactgctgcctcataatcctcaaaacaacctagagaattttttagaggtgaagaggctttagtgattatcaagaccagcagtttatcaactttggtcttgtttttggcaccgcaaccttttcttcaaaagagtcttaagtaaagttgtatcacttatccttcctgtggggatagagttgcaaaaatgcaagtgtcactctgatgtctcttgagtcaactgctcacctgctgtcagtgacagggtgtggggtaatgggatgagccctgcagagcccatgatcataggattaggtcaggaggaagacgaactccaggaaaaagctcccacaatagtagggctcttagctagaaggtggaaattcattctaacagaggtcttgttcacaagcatatttaattagtggcaagagcccaggaaaggactaaattcttgtaatttaggatggtctaaagtatggaaggctttatgtacatttctgaacagccttctcccccttcttggaggcagctgtttcaagtagcgactggtgctcagcctctggagctggcagcggagcccgtgggtgtggcgaggtcagaagagctttgctcaaagccagggtgggtgtggctgcctctgcagccctggcccacacccttcctctgtggactgaggcctcctcctgcccaaatccagagaggactcttaactcttcctcctgcaagactcagtcccaaggcccaggaaagccccagttgctaactctgatttggcccttgttgagctctccatggacatggtggcccctgtggacagggagacaggagagtggattctgctctcccccttcttcagcatcacgttcctcattctcactctctcatcttattaatggcggcaagagttgggaagatgtcacagcatatgggggcaggaggcaggggctatgcttcagacaggtgagtgattgcaaaggacaggctgatgaagggcctggaagaaggttaggaggggagtggggagggagcagtgagcctcatcccatggtgctgcatgctgggctcccacctgcaatgcctggcctccttcctctgccaattcaaatcctacacacttttgagagtccatcccaagtatcactcctctagaagtccaccagacattcctgccttccccgaccttccctcttctctgaaccctatggaggatatgttgtcttggactgagccctggcagatcttccttcaccagacttctggactgagatgatgcattaaactcctctgtatcctccagagagccaggttatcaggcactaacctaatgcagaaggaggtgacttagtcttaagctgtatcagcttcctgaaggctcaagtgccttcctgggacaggtggctctgtagggctctgagactctctgaacaggtacctctatcacagctcctgtcaccttatattgaagtgaccattctcactccagcctcgccctctgcagggcaaactgctgcagtcaccaatccatactcccatatgcattttgttatttccagggcattgcatagaattaacagggcaggaactcaacaaatggacagattcccaacaaaccaaatggaaattaagagactactgtgaagacacagaaaaaagaactggctgatgaataaggagaagtgggattttaaaaagttgtgatgcaaattccattataaactggaatcaaagtcagcattaactaatagtaacattaaaattattgccccaaaatgggtaattttaaatgtgactgtacaagaaaaatcttattttttcttgtgtacgtttaatcagattcttggaaataaactttctttctactcttggatactgcaaaaactggatatgcccaaatctaattttcatatggaaatagttgatatactattaggatttttaatctagtatcaccatttatagaaattttaaatttttttctattaaagaaaaatgcataattttttgagaagtctagatgatttcagccaaagaaaaatgaaagagttgatgagtattaatatagaaatggcctcctggatactgcaatttgtaagtcttagatttatggccggttccttaagagcagggaaatggctattgcatgctcccaggcatgattctttttatccaatgattctaatactttttctatctttcccttattaccaaaaaataatgtcattaaaatcttttttaaggaataaaagtgaaagccagtaggttttggttccttattcatacactcaggtttgtaaataagaaaaacaccccaaacacttcttttatttcccactgcatcattatttccaatgttaagttatcccatctaaaatctagccttttcactgtagaaatccacatttctcattccttaatactttttttttttttgagacagagtctcactctgtcacccagggtgcagtgcagcggcaccatctcggctcactgcaaccgctgcctcccgggttcaagtgatcctcctgcctcagcctcccgagtagctgggattacaggcatgcaccaccacactcggctaatttttgtatttttagtagtggccagctggtctcgaactcttgctctcaggtgatccgcctgcctcggcctcccaaagtactggaattacaagtgtgagccaccgcgtctggcctcattccttaatcctttgttagaactttctagtcaatacattagagataggtgctttagacgttcaaaggattttatgcacattaaggtcaaattctgactgaagggaagacccactgggcactcttgacccactagccagacaacaggtgtaaagacaggggcacatttggtgtgagctatgagcagtaggccacagtggcaggcagaggaagctgggtgccctagacatgagtgagggtgctgggtgtgtgctgaggtcacccaggcgccagggagaagccagggtggctgagggcttttaagaacatggacgcctactaatcagtgtgacattttttgcattgctctccgtaagtcctttccctgtcccaccccacacgctgaatcattctctagaacaatgttctctaacagaaatatgtgagtcgctatgtagttttaaattttctaggagctatgttaaaaaagccaacaaaaacaaaaacaaaaacaaaaacccaacgaatttttttgtttgtttgttttgagacggagtcttgctctgtcactcaggctggagtacagcggtacattcttggctcactgaaacctcagcctcctgggttcaagcgactctcctgactcagcctcctaagtagctgggattacaggcgcgtgccacatcctggctaatttttgtatttttagtagagacagggtttcactatgttcgtcgggctagtctcaaaatcctgacctcgtgatccacccatattggcctcccagagtgctgagattacaggtgtgagccactgtgcctggagttaattttaataatgatttaattattaatttaaataatataattagtaaattttaataatatatttcactcaatccaatatgttgtccaaatactgccatttaaacatatgaaaattacttatgatactgcttacattattttagtgcaaagtgttcacaatcatctgtgtatttcatacttaagcctacctcagctcagactccccatttcaagtgtttgacagccgcgtgtgcctggtagttcctggagtggacagcaccagtggccctggctgggccagtccttcgtatcttgggtgtttctggccccacgctcagttcttcactgggcgagtctcccagggtgggaccctcatatactcaaggacttcactgctgacagcttgattcatttaattcattagcttcccaacaaccaggggatatactgctggctcctacatctatgggcacacgtgtattctttttagtcgggtctcttgaaatagcctggaaatgtgcccttaaactgcaggggaaaaaaatctgggaaatgccttttcctgtaaaagctctgattttacatgcatgcccacagccaccacagtcagggctgccacacaggacagacagggaggggccgcccttccctactttgctgtgttataaatgaacatgttcagttccaacaaccttaataagcagaagatttctcaaatgcacaacacagtactccatttctacttttttattggtaagcgatgggatttcatttgtaatgtataattctgagaactcgtgggcacttacaagcactttaatgctctaagatgattgaggtgatgaagagactgcaataaaatatctctgaaaccaaagatgatcaatcacagggtcgttttccctagccagagagctctctagaatctatgaaaagattacttactggaaaaatgaaaaaaaaaaaaaaaaaaaaaaccaaaagaaaaaaccaaaaaaaaaaaaactaaaaacaaagccccaaccactccaacagggctctttaactgaacattagtcatccctttcccaagaaagacattcactcctcacagcctgacagcctcagacaacagttagctgtccaaacccattcagacaaaattgattatttttttttttcatgaggggtgcagataaaattctcaaatgaattgcctgagaagtcagtttgacataatatcccataaaatctttgctgcttggaagaactataaaaagtttcattaacatagagcttcattccactccaactctttgcaccaacttcatggcacgttagagcatcaaggctcaggtgatttacacacagggagcagaaatcattgcatctcagccaaagagtgtgcaattttaagtcggtttatctaacacttctattactcaaactctgcatttaatatttgcaaaaggtctaatgcagggtgtgcatcggcatcctacacagttatatctgcacccatgtggttttctacgaagagaagagaatcaggtcaaacttattattacacttgtattgctctttcttccttctgtattagacatggtctctggaagcccagagcatggactaacaagctctgccacatcttatagcacagcatgtgctttctaactatgtaataatgaaattcttttttttttttcttctttgagtcaggctcttaatttgttgcccaggctggagtgcagtggctcactgcagcctcaaactcctgggctaaagcgatcctcccgccatagcctagtgtagctaggactacaggcacgcgccaccatgcccagctaattttaaaattttttttgtagagatggagtcttgctatgttgcccagcttggtcaccaactcctggcttcaagtgatcctgctaccttggcgtcccaaagcactgaggttacagatgtgaaccagcatgcctggcctgatgaaattcttgatggctataggcagggacctgccagccttgcagtttcctttgctttcctcttctatcacccatttctttctaagggagtgaggcccttgtcataccctgaacgttttgaaggcatcaagtctcttaatccaacttctcttcccacctcggaatctcagtccagggcaaaaagtccacctagctcttgataagcagagactagaagaagtaggagaaagctggcgagggcgtgttttacaagagttccattcagtttcctgcagctttgagaatcctaaatgccacatggagtcctgccgcccattcagctgggcagcacggcaggtggggcgagatggccttcctgcccaaattctgcccaacttctgcccatcactgtcctgggtgtgggagattgggagggtgtgtatgtatggttgagattgtagatatcttactttgaaaaggactttccaacccaaagagcaactgtgaagagtccagagtttttacagagaaaaaaatgcaagtttcaggactacagagcaaatatagtgaggaagagcaatttgtaaaatactaaactaggtttctggacatacctctactgttaacagtaattctttatttaaataggcaagacattctgctcttgcagaaaggcccttgcgatcagaataagaggaaaatagatcctggtaaggacccaggttctgagaacaccttttagggtctgacatctctgccaggtgtgaagagctgagaatcagtggatctgagttctagccctagttctggtgttaactcctcagccataacttccttgtgctttctttacaatgaggataataaaaccagctttgtcttcttcacaggctattgctgaagacaacatgatataacagaattggaagtgctttcacaaacattgttttatgaacacaaggtaaggtagtgaacaaatacctgactttgtgaatttgcatgctgccaatatatgcacacctgcatcataaggtctcatttatgatgctctatgtttgttttttttcctttaaaaattttctgtgtattcccagctgttcaaaatataattccaagtgtgtatcatctgtagaattgggccactgcagagcactatgttgttcctgaacctaatccaaagtttcaagagctagcccatctctgaacttcccaccagcatgaaaaccctaatctaatctgtgcaacaataatctctagataggcatctctcacacttgcttttggagtactgttttagtagcttacttgtgttttttaaagttcatttctccacccacaggatagctccatatcttccagcaccactaatgagtaagtattagggccaagctggtatctgcagagtgctgactggccaagagtctgcctgtgactcatgccttaggctgtccagcattggggtgctggggggctgtagccataacatttgcaggatttggaaattccacctcaagctccaatcccagggtgttgattctggctaaccatgtttatgcaaagcaatccaagcactttgactcactttgggaatctggcattcttgggcttttgatattgagacagtggaacacttttgtatcagtttaggttctgccaataattgctatccatttaagcacttgattttttacatatttaccagcaatttccaaggctttaatggatagagttagcactcttctgcaaggagaaattgctccacagtgctaatagtcgtggattcacaggcactcagtgagaatattttaggcataagcttagttttattattgtaccttagagaaaccttgtatttttaactaggtggtaactttttactgtattagttaatcaaaagaaacataaatataaccaaaatgttatttttagtttgtactggattctataaaaatatgattacccattctagctttattttgatgttaatatttacatttaaatagaagaaaaacagtaaagggagcacatcaatgtaagaagtgtatggctttagtaaaatatataagaaactttggtaaacagggatttaaaaaactctaatcccttcaccaactcagaatgccagttccttacaaagctgcatacctgagcaaccacacatgtggtttctgtggatgagacatttaaatgatgcaatcattttgggataacagttatataatataaaggtttcacatgagtgtctagctgaaaaaccactgcgttttcctatgaatgcaaagaaacctctgctcaggtgttggaagctgtgcctctccagctgcctgccaccttccaccccttcacctgtggcttccgctggtttctgatgggcaccctttgatcactggggtcagttcaatttcctgggccactgggtcatgggcaggacatgaaaatgtaagaagagggaccatgcggttcacctaaatgacactcatttaataacaacatcaaaatccttgatgtgacaggacctatcgcctggcatactaaaagtggggagagcaattctctcatcttctgctgtagttaatgatatcttcctaaacctgcattaatcatcaagtgaacttctagggataacgtaacttctgggagaatttaaactgagattgaatttgtatctcagacggtagtgcccacagaggtgggcagtggcacaggcttccttcagcttgtgtcccaggtttatgggagaactcttctccctgtccctcaattcacacacaaaagtgcaaaacaggattatgggcatagggcatgggcaatttcatctacagcagtgccgatctctgcctcactctttgaggtcaccacaatgctttccttctgttcagaaccataatggtttctgtgtatcaattgtttgtgggcaactgctgaaagggaatcgagggataaacatgattctaaccaatcgcattctgtggtgtctatgggcttccacctgttaacatgggaaactttctgaatttaggttcatccccatcttgtggaattggatttccaccaagggttcctgctcctcatttagcgtggaagaaagtggattttgcaaataacattcatgatgttttgggcagtatctactctgcctgcaaggtaagaatgagtctgtgggagaacatccagctgctgcaacttgcttcaaagcctcctttttttttttttttgagacgaagtctcgctctgtcgcccaggctggagtgcagtggtgcgatctcagctcaatgcaacctccgcctgccgggttcatgcgattctcctgcctcagcctcccaaatagctgggattataggcgtgtgccaccatgcccggctaatttttgtatttttgatagagacagggtttcaccatcttggccaggctggtcttgaactcctggccttgtgatccacctgccttggcctcctacagtgctgggattacaggcgtgagccaccgtgcctggccaaagcctctgttttattggcttctctttggtgctcaaaattcccacgttcacattaccttgtttatttgaggtaaaggctttcatcaaaatcttcagttaagataaaaatggcaggaagataaaggtggggacttacaaattacattcttaaaagccacccacattttggtttatatctcttattaaatctgcagtacaaattggtttgtcagctctgtttacctgaaagtgtcctgagggaacagaacacatggcagagaagcctgtctggcagaattaaggactaggagctgggaagttccagagcttagaacaacgtccagaagacagacttgcaattgtgctgcagaaggacaaactgttgcctgttggcagaagatggggacagggggaaggaggaagcacagaaggaggaacagaaagggccaaagacaatgtctgtctgttgtgaggtccactggggctggccttggtcacctgcctgacctcctcggagtgagcgtgagacggtcacgtgtactcagggattgaggaggcccaatgctttcacacttcgtaaattcccggggaacactccacactcatactgaaagggacagtgtggccctgactgacagcatgtccaggaccagagtactaggcatgctggactccataggatttagaatgccacagtggccggagcagcaagctggcacactgggttagatggcaaagtgaggatgtgtgggtgtggacgtgggtgtgtgcgcaaggtggcggcaggatagactggtaacactcactcccatgcattttcagcttaggctacaaatgacaaatggcacaccaaagtgaggtgtggtcgtgcagacagaaaaagcaagggcctcctaatgcccaggaagcaaaaaggaaagaacgtctcttcggtacctcatgacttcctgctagaggcctgaagtcactggcacactggaggattctgttagtattctcatcaggtatgctgtttattagacagattaagactaaaagaaaatacacaaaaatagaaagctgcttctttgagaatgatgagtatgttttcaaaaactttaaattttaaatatttatagattcacatgaaggtgtcacaaaatgtacagggaagtcctgaacactcttcacccagcctctgccaaggttagtgtcatgagtaactgtagtaaaatgtcgaaaccaggaaactgacattagaacaatccacagagcttattcagatttcaacagttatgcatggactcatttgtgcatgtgtgtgcacgtagctatatgtaattttatcacacgtgtagctacacgtaacagtctaccacaatcaaagtatttaaccacaccatcaccacaaacgtctttcatgccagccctgtatagccacccctcaaccccaaccctaaccacaggtaaccactgatctgttctccgtctctatagttatgctatttcacaaaggttacatacgtggaatgtgaagtatctatccttttgaaattggctttttttccactcagcataaattccctgagatccatccaagttgtatgtattaaccgttcattccttttattgctgggtagcattcaatggacttttaggtagtttctggttcttggctattgcaaataaagctgctatgagccttcacgtacaagttgctgtgtgaaaatatatttttatttctctgggatatatgcccaagagtgcaaccgctgggtccattttcagctataaaaggaactaccaaattattttctggagtgtctataccattttacattttcaccagcaatatgttagtgagccagttactccacatccttgccagtgtttggtgttatcattattttagacattctggtaggtatgtactggtatctcatctcattgtggttttaatatgcattttcttttcttttttgagacagagtctcactctgtcactcagctggagtgcagtggcgccatcccagctcaccacaacctccgcctcccaggttcaagtgattctcctgcctcagcctcctgagtagctgggattacaggtgtgggccaccacactcagctaatttttgtatttttagtagagacagggtttcaccatgttagccaggctggtctcgaacccctgactcaagtgatctgcctgcctcagcctcctgaagtgctgggattacaggtgtgagccaccatgcctggccttaagttgtatttgctaatggctaatgaagttcagtatcttttcatgtgcttatttgccatctgtatattcacttcaatgaaatgtctgtgtatgtctttcatccattgttgtaactggatggtttctttaatgctaaggtctgggagttctttatatattccacatacaagccctttgttgaatatgtggtttacaaatagtttctcccaggccataatttctcttgacatcctcttagtaggtctttcacagagcaaaaggtttttaatattgatgaagtccaatttaccagtttttccttttatggatcaagctttttgtgtcaagtcagagaactcttcatccatttccaggtcccaaagatattttcttatgttttcatattagtttcctattgctgctataagaaattacacaaatttggtagcttaaaacaccacaagtatatttaccattctgcaggtgagaagtccaaaatcagtatcactgggctaacattaagatgatgcagggctgtgttccttctgaggcctctaggagagaatccatttccctgttttttccagtttctagaggcggcctgcctttctggactcatggcccctttttccatcttcaaagccagcagcatttccaaatctgtcactggctctgcaaagttccttctgccacgtaaggtaacacaatcacaggttttggggatgagcatgtgaatgatacggtggggggcattattctatcacagtttttttctagaagttcgaatgcattttgagttaatttttggatacgatgtgaagtttggattgaagttcattttattttagcctatgaatgtccgattgtttcaacaccattcattgaaaacgttccactccaccaatctccgtcttttaattgatgtatttagaccatttacattaaaagtaattattgacgtgttaggattgaagtctgccattttcttcgtttactgttttattccttttgtttctcatttctctctttttttttttcttttcttgccttcatgtgggtacttgaacatttttcttcttttttctttttgtttagagacagagtctcactctgtcacccaggctggagtgcagtggcatgatcatagctcactacatcctcacacatctggcctcaagcaatgcttttgccttggcctcccagagcactgggattacaggcatgagtcactgcaactggccttgaacatttcttagagttgcattttgatttacttataatgtttctgagtacactgctttgtacacagtttccttaggggttgttctaagtattgccatacacataggtaacttatcacagcttactggtgtcaatgttttaccacttccagtgaggtgtagagaccttacctccatttagatctctgtatcccctccagttttaaaatacaattatcttaagtatttcttccacatgcactgaccagcaccatcagatgtcattataacttctgcatcaccatttctttcatatgatgaaagaagctcatgagataaagaatagtctagtatgtttacttctatttttactcatcctgttctccctgctctgaaaatctcagctttgggcttttaccattttctttctggtggagaagttcctttagctattctttaagggtagatctactagaaacaagttctcttagttttcctgcagccatgctggagacctgcatgccttaaagtcatcagtggctgagcctcctggaagacctagcactacccacgtggcactctgtagacactaacatgtgccacttcagctcctggcaccctgataatggccaacaccaggtggcaaggtgcaggctaggctccccttgcccactcttggtcttgggcccaaggaaattagagttgaggcctattctcaagagagacagatcccttaggaggtcaatcaaggatagcagtgccgtgaaaactatcttcaatagctcagctgggtcagaacagtgttctagaagtttgagtctaaaatatgtgagccctgaaatccttcaacttctagggtgaccttgaggtgtcagagctattcctatatccagtaatactctattggcacaggccccaggcctgaaggtaccacatataacacaccctcattcatgaccaggggtgtaccttacaggaacaagaatataaccattcattagggctcagacctcagatgtcaaaaactcttagcagaaggattggctaagagctccaggaagacatcagagttagagatctcgatctgggaggcatctggacagagatgaaaattgcagctataggaatgcatgagatcaccatgagaagaaggtagaggaaaaaaaccaaaacagacccaaggctgaaccctggtaggaatatcaagaggatatagtaggatggcagcaaagaatagacggttcgaagaaggccttgtcaatggggttccatgctgcaaagaggtcaaggaagttaaagactgggaagatgtcagaggcttggcccaggggcaactaaaccatggaggcccacaatgcacagatgctgggaaccagctgtgagggaggaagggctggtgagaaattaaaggatgggaaaggagagagtgctcagtagtcacaatggttgatggatttgcctgtgtttgtattgtttgggaaaatatggaaatgttataagcctgagtaggaagaacaattaagaaaacaacaagagaggggctgggagaggagggggagagaaagaatgaggtcaacggcaccagaggagaaaaggatcaggcatttcttcctgaaatgggagagaagcaggcatgaatcaagctagaaataagtttaaggtgaaaaaaaaatagaaatttaggatgctgctccaaatgaactacacagctgactagcttatttttcttttgcattaaaaaacctttgggttggctgggcatggtggctcacgtctgcattcccagcactttgggaggccaaggtgggtggatcacctgaggtcacgagtttgagatcagcctggccaacatggtgaaaccctgtctctactaaaaatacaaaaattagcagggcatggtgacgggcacctgtaatgccagttactcaggaggctgaggcaggaggatcacttgaacccaggaggcggaggttgcagtgagccgagatcgtgtcattgtactccagcctgggtgacaagagcaaaactgcgcctcaaaaaaaaaaaaaaaaaaaaaaaaaacacgccctttgggttgctgaaattaatgtgatcctgttggggcaatggtggtttccaaatctgaccaaacatcaaaatcgattaagaaactttgcaaaaatacagcttcccaggccccaacccagccacacttaagcagaatccctggtagagggggcccaggaagcagcattttaaagtttcttcagtgatttagagggttaaaccaggtttgggacctctcgagttacgatgttcaaccatgtatgtatattagaatcataaggcaggtattggtagacccagactctccagattacaggtattaatatttttaaaaagctccacaagtgctctgatgtacaccctggttataaaccatagtcaggggactggtttggaaaaataaactatctggataggatacttgactttaccataccgattggtcctctgtcattcagattgcctgacaattaactttacacttttctcctattaaaacagcacctgcttctatccgggctgtcactggtgggctgatggttccctgtggcttctcagcggatttctccaggcagccaggcttgtgggcttaccatctctggccctctggaaagagcctggctttggaagtttttgtagtatctttaatgtaaagtatacaaaatttcattgttctttatctgaactaaccacacaatgcaccttataaaagaaacagtaagacacagaatggaggaaggactatagaaaaggcaataatagttcatatttcactgattagaaaaaaatattatcaggcagacccataattaatttggtgagaaaattccttgcaccattaggccgattttttgttttaaagcagcagtaacatcaccaaacaactacagaaatgagagtctcgcatatagctgtttggctttgagggaagctgtaagcccagccctctaaatgcctctcaaagaaatacaaattcttcttttatctaaaatgatggtgtgatccaattcctgctccagcagccccaacatatcatctgttggactctttaaagtttacggcacagacagaaactgtcagttcctctcctcttttataggacattcacatttgcatattcagcagacagcacaagcctcaaaggccatattccccagaatgtaatcatcctacttttgaaataccgaagatataatagtacaatgaaaatattcttaccccgatgaaggctggctccagttgtggcttagcaagtcaaaaactagtaaacttgcctgtaacaacatcctaaaattccaaaggttattcttccccatccacagttaaaaagccatctcctacagaacagtgtcatatctgtgacatgtccaagattaaaggaagagccttcttgcttttagtaatttgtctggttagagattaaagaaaaaaaaatcaatcttgaagctgtcagttaatatttttaaattaaaaaagccatcttcatgcttcatgggagaaatgtgtgatttttaaacagaggtaaattcctcttcgtatcaagtatcagataatttttttgcatttcagcacgaggcaaacaaacaaaaggttatccacgaagtttcaaacgcgtcttagtaacataaactgaagttaggtagccttctttgatattgaattaccaaagtatctcgctgaaaaaaaaatcccccttgcaattaataaacaagttgtggtattttaacaaagttccaaagctaagaatcttcacattccaaatctttccattcctggaagagctttggtatttagatgttaataggatgcctgccttttttttttttttctttttttggccaatcttcaggctaaagagtctgtgaagcagactttttccatcctatgacctcagttttaggatttctttcttgcaaaatttagttattttggttggcagattgccagaattcattcttattttctttctccttctggtactttctccctttacccccttctgtttctctcccttcttcacctatcttgtattattctctgaattgaattaagaatttaaagtccggttggtggactggactacagtctctatgatgtttggtagggttgttagaattagcaaatgaaaatacaggatgcctagttaaatttgaatttcaggtaaacaacaaacaaatttttagcataagtatgtcccaaatattgcatgagacacatttacactacaaattattttcaagtattgcatgggacatacatattgtaaaaaattactgtttatctgaaattcaaatttaactgggcgtcttatattttatctggcaacactactttggaggttcaatggaagggattttaaaaaaaacaaaggcatccatttacaactcctggaagaagagaaatttccactcctatcctcttgaacgctttttgtctagatgtaatgttcttgattacctcattttagtttatttttgacccagtaagttgtactaaaagctccacagagcatgtcacatccttatattaaagaagtccatcccaggtttcaggtctcactcggtgtcaggccaggccagagcttgcaaaattggtcccccaggcaacatgggaccttggcgcagtaacagaacaatgcaaatgctccagttttaattttttccttcaaaatctgaacaccaaatttagtacttttgaaggcactgatatagttttctctcctcagtgctcactttggggcaatttagcatgattagtaatagtgattattagaaaacccaatagaattcacatgaatgttgaaatgtaataaaatgatcactttttgggcattttgaaagggcagataaaaatattgatatgcttctgacatttaaagataagatgaagatcttaattacattaattattaattcaggtgtatttctgaacatctaaagaaacccaggagggcgacacataattccaaaatgccgttctcttatttagagacacattgatattcagtattttggaactattttgaagtttaatagctgaaatggaggctgtactttaaattcttaaactggactttaaattcttaattcaattcaaagaataatacaagataggtgaagaaggaagagaaacagaagggggtaaagggagaaagtaccagaaggagaaacaaaataatcacacagaggtgtgagaaaaagtatgggctctaggcgggtgcagagtcaggtgctctagcacctgtttgtgaacccagctactcaggaggctgagcagggaggatcacttaagcccaggagttcaaggccagcccaggcaaatagggagatctcttttttgaaaaaagtatgagttcaggagtcaaactgggttcaaaccctagctctgtcacaaactagctgtgtgaggctggtccagtttcctaacctttctgtgcacatattccttatctgaaaatggggataaccaccccagagagccgtaagagtatgagacaagcactcagaacagtgccaagaacacagtaaatgctcagtaagttttaggggtgaagatcacgtgatctagcccaaactatcaatagaaagataaaactcaccaagtcagagaatgtctccactttgataactgggtcatgagagaaaagatttttctcttgcagtcaaatgggtattttaaaaaaattataaatagcaatattttatgtatttactcattaaaaagaaacttctctttattttcagaggatacaacttccaaggttgtgtgaaattagcatgatactactgttccaagaagtgaagctatatggttatcagttctatccaactactggttattcttgtttcaccctacttattattctatttactcccagaaactccacaagcaaataaatgacactctttctcatccctacccccaaagccaattaatcgaacttgatcgtctagctttactgttaagcagattttcaaatgaaatagtcccaaatcactgggtttccagccatctggaaaccactttgaacttcatttgtttatccatgtttttaatgcagctcaggtgtctgtagtctgaggcagtgaggaaaacaagtgcttctgagtcaaacacctctggggtaaaatcctggcttggccatgctgcctacctgggtgagctctctctgccttggtttcttatctatacaatgggatattctaatgttgtctcctttctgagttgctataaagattcgaagagctgattcatgtatagggtgatcctatgtttcagcttacacttattgtccctgcagaattgttacactattacccttatttttataaagtatttaatacagagcctggcacacagtattcagtatttgttttttgtttctttttttgagacagagtctctattgtccaggctggagtgcagtgttgcgatcttgggtcattgcaacctctgcttccccagttcaagggattatcatgcctcagcttcttcccaagtagctgggattacaggcgtgcgctaccatgcccgactaatttttgtatttttagtagagatggggtttcaccatgttggtaaagttggtctcgaactcctgacctcaagtgatcagccttccaaagtgttggtattacaggtgtgaggcactgtgcctggccagtattcagtatttgttacctcttaatcatgatataccaacacctgcagtattctaactaaatccttgaaatcccatggaatccttatttttaaagcaagaatagccttttttgacacaaaaaggtgagtgcctgcctgaatgtgaaagtttggtcacctgcccattatctccacattccctgtccctttggatatttcagtcatttaagaagttaaaagtgggggtggaattctctgcggtagaaccttggaggcagaggctaacatattttacatgctttggcaggatcatgtgagcacagctttactaaaatacactctgccaacagcagaaggccctctgaggtgagcaggtgggacgaggctgggaagctgtcacttgacttctgccagctactcggaatgtcagatgaatcccagactgcagcccctgcggtttccaaggcccccatcactgcacagaaataccaggctcactcagcgacaggagccaggcttcctcctgtcgctcctccccagcctcctcacagcctcaagatgcaattctcttgacagtagggagggagggcagatattaagggcttttagggaaataccagccctttcttcagaaatggggtttcttccttaacatctctcccgtttcatgtgccctctgtgccaggccgcgtgtggtgtctccaagaggatctggagcaggcggacccagtcggaatcttggctctgcggctcatgactgcaaacccctccaggagccaactcacttctctgagacctcgtttttctcttctgtaatatgagatgtaataatgtaataatacatctcattggattgttatgaggattaaatgagacaacatgtccagtagactgcctggtacaaaataggcatctaaggcatgccaagtatctttatggtcccaggctgcctgagaaggggtcagcattagaggcatgcgggtgcaaagagaacctgcgatctaggggtggaaggtgggcgggcttcagtgtgcaaatatgcaagcttggcatttaggaggttttacatctcaactagaatccaaggaagagggagaacaaatccagctgatggtatttctgaaagaagacgcacagcgaatgtatgtgttccagccatcctttgtagtatcctgcattccttcatttattcatactgtacttgcttattgaataagtactatgttctcaatgctagaaacacttcaacacaagagcatgaagattcattaaagataacattgggaggaagcacaggcagtctgttaatgtcaggcaatatttattgattgcttgctgcagtcaataaatatggtaataccagccacaatctcccacagcccgggcgactcctcagaaaaacgttggcacctgttaaagccacagtgagtatggagtagctgaagtttcttaactcatgtctctgtggactgaagagctcattgcaaaagggccaaactcgcttccagagactgttccccaccttaatcataactgaagtaaaccattgcttatgtggtctaactggagtcactgaaaacttcccttctcccatgacatatattccaaatgcctacttgttgaacctatgaatgggtcctaaaatattctgggttgtcagttctttgggttaaaactttcctaggtcctactggaatgctcttgggttctccaaggggaatacttcagggagccatatattctagtcgcctcttggcagcgtgcaccagaggaaaggcctgtgtaggaagacactcactggctgagctctttcagcctcagtttcctcatctgtaaattgaggaaagacgagcccagctttcagagctactgggaagactgaagagatcatttacacaaagtgactaggccagggctagaaacatggcaggggcccagtgcatgccatttccttctccttcctcactcctttggcacaaagcatctcagaagttggtcagtaacctctactgtgttttgtgaacaggggctgacaaaagtgaacatgtgcaattgtgacctgcatttaaaaagatgaggaatagaaaatgtcagagtaatggtaggtgatctttgcgacacttttgcttcagtacacacattcacaaaggatacggtataaaatgtacttctgactgtgtaggttatagtcataaagttttgaggtgggtatatacccccaaaaattaagaacaggggctcaaagagataatgtaaacccacgttcctggcagccttattcacaatggccaaaaggtggagccaacccaagtgtccattgacggataaatggataaacaaaatgtggtctgtacatataatggaatattactcagccttaaaaaggaagaaaattctgacacatgctgcaacatggatgaaccctgtggacattacactttggaaaataagccagacacgcaaggacaaatactgtatgattccacttatatgaggtccccagagtagtcaaatgtaaagagacagcaatggtgattaccagaaatggggaggagcagggaacagggagttattgtttaatgggcacagagtttcagtttgggaagataaaaagagttctaaggagagggtggtgacggccgctcaacatgtaaatgtattaatccttgatgccactgaactgcacacttgaaaatggttaagatggtacattttatgttatgtgtattctgccagagttaatttttttttttttttttttgagacagagtctcgctctgtcgctaggctgcagtgcagtggcacaatctcggctcactgcaacctctgactccctggttcaagcgattctcctgcctcagcctcccgagtagctgggattacaggcacgtgccaccacgctcagctaatttttgtatttttagtagagatggggtttcaccctgttggccaggttggtctcaatctcctgacctcatgatccgcccgcctcagcctcccaaagtgctaggattacagacaattaaaattttaaaaaattaaattaaaaaatatttgaggaaccttgacctagataaccccccgaggaaaggtacatttggaaggagcctgggtgtagaagacaaagggtgggccctgggcaattaaacaggagacaggggaatatagactccctattttttttttttctagagagagtcttgttctgttgctctggctagagtggcaatggtgtgacctcagctcactgcagcctctacctcccaggttcaagcaattctcctgcctcagcctcctgagtagctgggattacaggcgcccgctaccatgcccggctaattttcttgtatttttagtagagatggggtttcaccatgttggcgaggctggtcttgaactcctgacctcaggtgatctgcctgcctcagcctcccaaagtgctgggattacaggggtgagccaccatgcccagccagactccctaattttataaactctcttttacgacctctgggaacccggaccttccaatgtcgtgccagaacacagaaaatggggttcgcagtctttttctatgatggtatcatttccaacagacattcctgtgttttagtgttttattctgagagcaaaacaaatacaacagcaatgcctaatcgccctctcaggtgaaactgacctttcctcctcacctcttctccttcagtaactctccccagcccaaagctgactccttggtaggcaaaggctggtcagtcttccttccttattcactgaataagccatgcccctttgcaggcctccagtctaatttgtgattctaactaatgaggtggggtctgaggaacttgaagaggccctttctattttattttttattcttggtttccaatagttggagaaacaggatctggccaactttctctagacaaaggctgtatgctaggtttttcattttcttagctgaaatgattgtggcaaatcacttaaacagatacaaaaaggaggtctctgtggacggacacctcatagactaaaagatcagccacagttcatcattttagacatatattgctagagccaaaataagtatcaggaaggtttcaagtttctctggaaaagaaaatcttttggtaacaattctcaaatcgaccttgatctctcaacttccagacactactctatgatcagtttgtgtaaccttattgttaaatgcacttgcataaatgatagatttctttatatgtttagcacacaattgttcctctgtattttttccctccatatttaatgttttctaagatagtgctacaatgagctaattaaaaaattttaatgaatattatatcaatgcagggacactgacatgaacatgttgcactttgcatgtttctatatgactccaagttgcacattatgtacctgaaagagcctctgggcatcatccagacctgctccaccaatctgtggtgctcacgtcttccaagacattttgaaatagaagtcagtggtggaggtgaattcttcagcctcctgcaggacctgcatccttcactctggggagaggtaaagccacacgcttcttgctgatggtcctactcttggagaaggtcctgtccttggagaagagctcactctggctggcatctctggagtagaccactcagtctttctcctcctcagccctagcttcatgagatcttttaaaactttctattaatttttgtttttaccacccttaacatcttcttagttttccacgttttagttttaaaaaagaagagaaaaattctagtaaagctctgatcagtatcaactgcagacacgaggctgttttatagcttttataagttatgaatattgttataacaggaggaacaatgatttatttagtgcctattacgaaacaggcactttccatatatgaattccaactaatatattaatttttgaagaaggaacatttcatgggtctgagcttataacagttataagacttataatgcggtctgagcttataatagtttccaagtcttttactgtacacctggctggatcattttccttctgcctcattttgtttattttttcctccgaggagttcaacactctctgtttatttctgatttatgtaggtcatttcaaatctttttttttttttttgagatggagtctcactgtgtcacccaggctggagtgcagtggtgtgatttcagctcactgcaagctccgcctcccaggttcacgccgttcttctgcctcagcctcccgagtagctgggactacaggtacatgccaccatgcccggctaatttttttgtatttttagtagagacagggtttcaccgtgttagccaggatggtctcgatctcctgacctcgtgatccgcctgcctcggcctcccaaagtgctgggattacaggtgtgagccactgcgctcagcctcaaatcttcatttattctttaaggctacagttactttgtacgattgagggttatctacaaatgtagaaggatatgctcttgggatctgtctacaagcctgtgtaattgacccttgacttgagagtggattttcagtggtggtaaatgtggattgagcaagcacagtgatcctgccaaattgtggccttcatggaatcttggaaatcttcatctgctcattattcctagaatttttctagtataggcaacagtctagcaggatgttgacctactgcttttcaggcattatttcaattacttgatcttcttgagatggttattgtctctagagaaacaatataagagctctgggatagtagcagaatgggacagtggttaagagcttggcttctaggatctgaatcttgggttcaaatcttggctttgccactttaagttaataaacacagggacattagttcgcctctttctactggtaaaacaggagtattactggattgctgtaagggttagagaggataacacatgtcaagtgccaagagttgtaccttgttaaggtaagtgttcaaaacaggttaattattatcaggtaaaaaagctgtcacataactatatatatatatatataggctgggtgtggtggctcatgtctgtaatcccagcactttgggaggccaaggtgggcggatcactagatcaggagttcgagaccagcctggccaacatggtgaaaccccatctctactaaaaatacaaaaattatctgggcgttgtggtgcttccctgtaatcgcagctactttgggggggctgaggcaggagaatcgtttgaacccaggaggcagaggctgcagtgagctgagatcacaccactgcactccagcctgggtgacagagtgagactccgtctcaaaaaaaaaatatatatatatatatcccatcatggcaactcccaatcaatccccagcctctcacagcaacccctgttgcctttttcttgaacttcacataaagcaaattttacagtatacactcttatgtgtctggcttctttcatttaacataagcttctgtgattgatccatgctatagcgtgagcagtttgttgctatttgattagaagtattccattgtatgaatataccacaactgtttattcacgagttgatggacattggggttcagttttgcacagttatgaatcaagtagctacgaatattcttgcacgaatctttttaatgaatatgtttttcatttttcttgtactaatgcctacaaatgcaatggctaggtcatgcaataaatgtgtgttcatttataagaaacaaacagttttcaaaaattgttaggccattttacactcctactagcaacgcatgagagtttaaattgctccatacacttaccatgatttagtggtattggtatttttaatttgagccattctagtgggtgtatactggtatctcattgtggctttaatttgtatttccctaaaataaacgttattagtgaaaagcaccttttcatctgcttattggccaatttgtgtatcttcttttgtctgttcaaagcttttgtccatttaagaaatttataattttgtcattgaattgtcagaatatcttatatattctagacacaaattatttgtcagatacacgtattgcgaatatattctcccggttcgcagcttgacttttcattttgatgagcagttatctttaaattttgatgaagtccaatccattagaactttctttcatgttgtgtggttttgtgacctctgtaagacatctctgtctgttcctagttgtaaagatactgtcttctgttttcctctagaaactttgttgttttagcgtttatattgagatctgtgctccctctcaattgtgtgtggtatgagattcatttttcccctgagaagttgctctggcatcatttgttgaaaagacccggctttccccactggactgctttggtgtctctgaggaaaatcaaatgaccatatccatatggatccacttctagactattttttctattgatttatttgtctgcccttatatcagtgccacactgtcttaaattactttagttttacagtaagtcttgaagtcaggtactgtaaggcctctaactctgttgttcttaaagactgttttggctacctcttttggttttctataaagattttagaatctgtaaaaccattttctataaaaatgtcctgcaggtcttttgatcaagattgtgttgaatctatagatcaagatgagaaaaatcgagatgtcaacactatcaagttttccaattcatgaacgtctctccatttagttaggttttaaatttctctcaaagatgttttgtaattttcattatacaagtcttacacttctttggctacatttactcagtttttatgttttttatgtcagtttaaatggaattgctttttaaatctcattttccaattgtttattgttgataaatggaaacacaatagatttttggttattgacctttataagtttacttactgattctagtacttgtttagtagtagtccttagattcttaggactttgtccataaacagtaattattttcaatctttatgtctactacttcctttccttgccttattgcctgaccaaaacctccaggacaatgttgaatagaggtgataagggtagatatcattgctgtattcctgatcttaggaagaagtgcttggaaattcactattgaatatgaatttagcagtaggtttttcaatttttttttttttttcagaaggagtctcactctgttggccaggctggactgcagtggcacgatctcagcccactgcaagctctgcctcccgggttcatgccattctcctgcctcagcctcccgagtagctgggactacaggtgcccgccaccatgcccggctaattttttgtatttttagtagagacgggttttcaccgtgttaagccaggatggtcttgatctcctgacctcatgatccacccgccttggcctcccaaagtgctgggattataggtgtgagccaacgcgcccggccttttttttttttttttttttcctgatggccatcattagaataaataagtttccttctagtcctagttggctgggagtgttttttttttctttttaaatcatgaatggatgctccattttgccagaagctttttctgcatctatttagatgaccatgtggtttttcttccttattctattcatatagtggaatacattaagtgattttctaatggtaaaccaaccatgcactcctgtgataaatcctgcttagtcatagtgaattacattattttcatgcgtcactgaatcagatatgctaatatgttgtgaataatttttgcatcagtgtttgtgcaaacattgatgggatattgtatgatatttttcttttcttatcaagtttatgtcaggttttggtatcagggttgtactgaccttatacaataaattgggtagttttccttctccctttattttctgaaagtttgtataagagtgttagttcatttgttggtgttccattgatataaatatatcttaaagttttcatagaatttaccagtgaccttttgagtattataaaatgtccttttttgcctcttatactctttgtcttgaagtctatgtggtagcattaatatggtcacgaatcagctttcttatgcttattatttacatagtttatcttttctgtcttctggcttcaacctacttgtgttttatttaaagtacgtattggccgggcacggtggctcacgccttaatcccagcactttgtgaggccgaggagggtggatcacaaggtcaggagatggagaccacggtgaaaccccatctctactaaaaatacaaaaaattagccgggcatggtggcgggcgcctgtagtcccagctactcaggaggctgaggcaggagaatggcgtgaacccgggaggcggagcttgcagtgagctgagatcgcgccaatgcactccagcctgggtgacagagcgagactccgtatcaaaaataaataaataaacaaacaaacaaataaataaagtacgtatcatgtagaccgcaggcagtcttaattttgtagctggtctgacaatcttttccttttaattggagttttttcagtccatgctatagtttggatatggtttgtctgtctccatcaaatctcatgttggaatttgatccccagtgtggtggtattgggagctggggcccagagggtggtgtctgggtcatgggcatggatgcctcataaacagattaatgtcctccctgaaggtgagtgagttctcactcttgagataataaattagctctagaggagatgaaagagttcctggaagagtaggttgttataaagccagaccatctcttaggtttccctcttcgcacctgcccatttcccctttgcccttctctatcatgttttgatgcagcatagaagtcctcaccagaagccaagcagatgctgatgccctgcttcccatacagcctgcagaaccgcgagctaaggatgcctcttttcttcataaaccacccaggatcaggtattctgtaatagcaacactaaatggactatgacagtccatttgtatttaatgcagttactaatatgactgggttcaggtttactatttttcaatttgttttctattgataccttctgtttttcatttctggtctttctttcccgccatcttttatgttaatctattttttagtattttattttaattcctacaatgacttcttagctctgctgcttttggatatttgtttttagtggtttctctgggtattataccacacatctttatcttatccccagtctatttagatttaatgtcatatcacttcacataaaatgtaaaaactttgcagttgtgtagaattccacttgccttcccttattgtttgtgctattttgttatatattttacatctgcatacatcacaaatcccacaaaataatattttgattcttacattaattaaaaaaagatttacccacatatttattatttcctataaatattttcttcttgtaggtttgagcttccatctcatattattaccctgtggcctgacaaattttctttgtcaatttattgtagtgtaggcctactggaaatgaattctctcatattttgtacatcccaacatgtctttattttactgtcaattctgaaggatatttttgattatttagaattctgggttgggtgtggtggctcatgcctgtaaccccagcactttcggaggccaaggtgggcggatcatgagatcaggagattgagatcatcctggccaacatggtgaaatcctgtctctactaaaaatacaaaaattagctgggcatggtggcacgcacctgtagtcccagctactcaggaagctgaggcaggacaatcgcttgaacctgggaggcagaggttgcagtgagctgagatagcaccactacactccagcctggggacagagtgagactctgtctcaaaaaaaaaaagaaaaaaaaaaagaattctggcttgacagttcttcctttttctcttttgtctttcagcaccttaaagatgcctttgcactgtattacatatttgtgatgagaattcttcagttaattgtatctgtgttcccctgtgtataagatattatttttctctggctgtcttaaagattttctttttctgtttagtttcccataatgttccacggtgtagttttatttgtgtttatcttgcttgcagcttgctgagcttcttgaatctataaattaatgttttcatccaatttgggaagttttcagctattattccttcagatattttttcaggtctattttgtctctcctctcctcctggcatcacaatgcatgtatatcagactacttgatattatcctacaattcactgaggctctgttgattgttttttaatctttattctgtttttcacattgaacaattcttactgatatgagtttaagtttactgattattttttcatttctatgcttcatttatttcaaatgttacatttttcagttccagagttttcatttggttattcttattggtttccattatcctgctgagattctccttcttttcagtcatgatgactatgttttcctttacatccttggacatattatagtagttgctttataattcttgtctgaaaattctaatatctaggtcacctcaagatctattacagtggctattttttctcttgattatgggtcacattttcccactcatatgtcttttaagttttggttagataatgaacactgtaaattttgttttagagattccaaactctcttcttttaaacaatgttgattgttttttgttctatcaggcaataaaatctctagctgattagcttgagcttttgggtacttagtgttatactttgttaggaaggatctgtttcggttttgcccttaatgttacggtgactcctttacactgaaagcacacaccccttctggggtttcaatagaaaatctgaggcatttaccaagcccctctaacttgggtgggattcagattctgaactttgtaggcagtagctgtaggcagtaggcagcagctgaaaagagtctctgctcagcatttttggctttctagttattgttttccactacgctcattggcatattccccacacatatgcagtttaggggttattcaaggattgatggaaatttatatacagaatggagggctctcttctttatggctcttttctttctgtgacttactcaattcccagccactctggcagccctaaactctatcccctgacacctcaagccattacagctgtggctttctccttgagttctaattgttctttgtggactggggcatgccttcatgggagaagctatataaacatagttctcactctttcaaggatcaaatgaccctctttcaaggatcaaatttcctacattctctgccttcttttagttagactatgaatagtttttttaacaaaagtattttgtccagagtttgtaacagctatctgcaggagagttagtctaagataggttcttccatcattaatataactggaagtctgtcacagacattttaatttgtgcttttgtgtgtgcacgcatgttaagattaaatcgctcctttcattgccctgaatgctcataggatcactaaataatatatattgaaggattactcgggtgttgtccagactgtgtcatactgccaagcattgaccatctgaaaccaatcatgatcgatctcccgtttttaaaggaggccatgaagaaagatgcttccttaggaaataagctcttctgtttggagactcccaaccttgtattacaatttaagtccatataatggctttaatgactcagggtcatagagttatacagacagagggatgtataggccttactgaagccacactggttccaccacaccatgaatatgagagaggcatctttcccagtgccccatgcttgctagccctgttttcttcgctctgctccactcctgcagctgccatggagcctattatgtttcatgttttacttaggctgtctccccttttcccattttcagaaatctgtgtacccctggttctgtttacctgacttctgaatcactctgattactctgccccttaatgttacaggccaaactacttcttcccaaaatttatatgttgaaatcctaacttccagtgcctcagaatgtgactttatttagtgacagggtctttacagaggtaatcaagttaaaatgacgtcattagggtgggccctaatccaatatgactgctgactatataaacagacacagagatagacatgcacagagagacgatgacgtgaggacacgttgggaggagacggtcacctacaagcgaaggagagaggccggggataactcctctctttacatctcccagaagcaaccaaccctgctgacaccctgactgggacttccagcctccagaaccatgagaaaataaatttctgttactttcgccacctacttgctggtactttgctctggcagccctaccagatcagtatgcttgccacttaacaaatcctctgctcccaattttcctacttgattgtgactcatggctttagtttgtctcttgagacccacaccccctcttggtatggaaaatgggcaaaaatcagaaggtttatgctctaactcctcacttcagtggaatgacctttctttttttttttttttttttgagacacagtctcatgctgttgcccaggctggagtgcagtggtgcaatcttggctcactgcaaccttcgcctcctaggttcaagcaattctcctgcctcagcctccccagtagctgggattacaggcgcatgccaccacactcagctaatttttgtgtttttagtagaggtggggtttcgccatgttggccaggctggtttcaaacttctgacttcaggtgatccacccacctgggcctcccaaagtgctgggattacaagtgtgagacaccgcacctggcctggagtgacctttctgatcctcagattccttatccataatatggggatattgtttctatcctacctacctaaaaaagctcagatagatgctgcacataagaatgtaaaatactacacaaatcaaaggcatcctgaatctcactctttatccgtaatgtactgtacctcatacccaattataacagaacctctgttagaggtctcttgagcggtttcaagttcagaattctccattcataggagagatgcttgcaacctgttatttctagtttaagaggcaggtgcctaagaaaccgttttgctcaaagaggcaggaatatggggtgatgcttcaagctcccattgtttttatatttccagagggtttaaaagtaattcctcagacaacttacctattttttttcttttttttttctgagatagaatctccctctgtcacccaggctggagtgcagtggtgcgatctctgctcactgcaacctccgcctcccgggttcaagtgattctcctgactcagccacctgagtagctgagattacaggcacgcgccaccatgcccagctaatttttttttgtatttttggtagagatggggtttcagcatgatggtcaggctagtttcgaactcctgacctcgtgatccgccccccttggcctcccaaagtgctgggattacaggtgtgagccaccgtgcctggccaacttacctattttcatagatgttataagaaataaggtacagagtaaagcaaaccagtgcttttaggcaataaactttttatttttttatttattatttttgagacagtcttactttgtcacccaggctggagcacagtggcatgatcctgggtttaagctattcttgtgcctcagcctcccgtgtagctgggattacaggtgtctgccaccacacccagctaatttttgtatttttagtagagacgaggttttgccattttggccaggctggtctcaaattcctggtctcaagtgatctgcctgcctcggcctcccaaagtgttgggattacaagcgtgagccactgagcctggctgggaacggacattttagaaatacgtaagggaaggagaactttagaagcacatccaactgccttaaccaaatgggtgcctactgaatgtgatttttaactatgtaaaattaaatgtaggatgctagtcactttccaacatactttgtatattctttgtcagtctttaaaataatttcattattgagaatttgaaaaaattgtttctacaattaaaacttttataaaataatttattaaaaaatacaacttcccccaaatagcttacattctggttgcatgaatttttatgcagtttctactgttactcaaaagaactgaattttcaatgattctacccttttcagttctctagaatgcctccagatggcattaaaagcctttcccattatattttacaacacaaaaaaattaaaaattagtaacattttaaccatttaagaccagtcacattcattataacatctgaaagcaggacaatggaactatttaaacttttagggaagtatcttaagaaagacaaacatataatcatatctcttatgaaatacacagctctcctattcaagccaaaggatctttctagacaaagaaacagattttggacaaaataagacactcagtattttaccacaaactgatttccaatcaacagcacttaaaaaatgctgttttttaaaatcctgatccccatacagataaattcacaaagcctatcttataataagaaaacacatgccactgctcataagtgataaaaataaagatttttaaggagcaaacctgttattgactcttatggaactaaaataaagtcacttgttagctcatgaattttttaatttaaatgttggtatatcaatttggcatcaaattaatcagtaaaaatatatttggattccttgaatattgagaagaaacagacaaaacatagagtgaggagcacatgttttataagggccttttcttatgtttttaaaactgcttttgttaattcaaaaaagaaactcttgagattccagagatatcgataattgtgcttttcacataattccaaggtgaggttgcagatggcaagcttctgaaatgaccttgttactgcacagctgtgtgggacagcatacctcccagtttaagtgtgaaaagttctgcaattcttaagatgatgctgaaagtctccaaccaaatccccccagcatacatgctcaaatctcattacatttctacttcataaagagaagcatttgcatttttcaagattcctcttactctgctaaagcataaaaaatgcatctgcacccaaagcatttagaaagacattatcatgagaaaagagaaccatgggcttccttccatcatcattattactattacaagatacttgcactatctcattttatgaggcatatttaagaacaggcatctctgatagaaaatgaaagaaacttacgatgtattcgatgtgccactgtctggactctctggctctgcatcacctttctcttaaaaaggaagcagaaaaaaataccgacatatgagtcttacagtctttaagatttaagagagattaaatatatttccatgctcctattaacaatctttcaaaatgtgtagcaggaggcttttaaaacatcttttattgtctgagaaccggatttgcaaaataatttcttttctgcaatgcaactgcccaggcacaaatctgtgagtaggtactgaggagctatttgcaaacaaccagaggcttggagtggagactttgccagaagatgaatatcttacagatggaacctgtttccttccacttcactttacagaaaatttcaggaaataaatccattggcattctatatccaaggcactttgaactttgattgcttctgctaacataagccaaaccaggtcaggctgaatcagaacttggaggaaagaattttttttttttttttttttgaggcagagtctcactctgtcacccaggctggagtgcagtggcacaatctcggctcactgcaacctccacctcccgggttcaagcaattctccagtctcagcctcccgagtagctgggactacaggtgcctgccaccacacctggctgatttttatattttttgtagagacagggtttcaccatgttggccaggctggtctcgaactcctgacctcaagtgatctgcccgcctcggcctctcaaagtgttggaattacaggcgtgaaccaccacgtccggccaggaggagagaatttttactgaacactgaggttgcactgtaggtcccaagatccccctattttataccccatagagagccctggtggcaggttttggggcccctagcttaaagcagaatgagatgtaaaccagaaatcctttctgaccatctgaaaggctagttaaggaaatgcttctgtgggctgtgatcactgaggaattaacgagttgtacgtagttgggggagcttggaaccagttcacttcttgtagtttacagtaggcttaatgtaattcctaatccttaatcaattggtggtttgaaccatgcatcctcattctgtaaggagtttctttgtatttccttgaggcttggagatggaagaagtcactgataactgagagcgtgggctcgtgtgtttcctgatggttgtgcagagccaatacaccccagagaaggctgtgagttgcaagaaataggactgtggtagtaacttggtttgctatgctctttcaagtcaggcctggagatctctagaatcccttggtctactgctcacgtccttgggcccacacattgtaccataccccttttgtcagctgtcaacattagcttgtcgtcacctagtcccaggaatgactccctaaattacataatgaacatatcccaaaggtattgcccaaactgaactcaaaagcaaactttatatgtccttctctttttcttataggaataaacagttgtgagaaaaagaagacacagtttctacagttcgtacatctatctcagacatttatccagtgccagaacagctatgagggactttggctaaaagctggtcagatgagggggaaaaacaaaaaagccacaaaatctattttaactgccttgataacaaacattgattaggcagggcctcaatacatataaaaccatgttggaataaaggctaaagtagcaaattaataaatttgctttaaagctcattcttgtatattttcttttgtcttccaggcaaggtctgtggtgcactcatttaggaggcaaataaggcctgttcaactggtttcagtgctggaaaataatttagtactttgcagaaacattttttccatggactaaccacaatccctcttgtaatcctaaaatagagagttataacacctgcattatataagacaaaactaaatggaagtatattttttttctcaaatatatggatcctttcccccaacctgctttaatttggtgaaactggttactttccccagtctctagcctgcagtagttaccacattccatcttaatgaagaatgtaaaacagcaggcttggaagcagcaggcaatggtaaaattcccaaacaatttatgtcagaaaacaggaaattgaaaataaaaacgaaggcattgtttggatgtttgaagaaatatgttttgccttgaccaatcatgctgcccaagtcttcagcatggggacagatgcgcagctgattatctttgctcttagcagcacttatgttgtggcaacagggcaaacagaataggttctggcaaataggaaggatatagtggggccaaacaggacatggtgaacagtctgagagggagtgttctcagcaaattcagtgctgataatgaatttgcctttctggggggaaaagtaagctggtcaggaacgagatgggattaaaactatttttgtccttcagaaagaataaaacacaaagcttcccccacatcttgaaattttaggtgatgaaatttctgaagttaacttgaaatgtttaagtgtatacaccactgagaattatggtctctttattaggacccaagggaaaatgatgaatgtaatggaacattctagaacattagtacaaatttttttttttttagttgggtgtgcaggagatgtttcccaccccgccccctgcccgccccaccatccaaagacagctgtctccagggtcctcctgtttgtgtcagctgttttcatgatggatatttcatgatggaccaatgtttcacactggtctctttgggagggaatctgcattggtcattaataagctgggtgcagggaagccattttacatgcggaaatacaattacagagaggaagaggggaaaaaatgagccacggaaagaactatatatgcaaatatatatgcatatatgtaaatatatgtaaaatctatgtatctatgtgtattatacactttcaatttgacagtccatatttgtctggctgggccttccacattgcctaacatacactaggtgctcagtatgtgtcttctgttctgatgccctgtcactaatacagaattccatgctgcagtgggaaaagatgcttaaggtaccctcgccagtgagacgaaatatacagtttgagatatgaaacagcttgctgactccaataggtcacttaaaaaattataacagttacctttttaacgcaatgtacagaggacttctatgttgggtgctcttgtgagcataaagataaataatgtggaattcatgctctttaaacatttaaatggactgcactgctggagtatcttactttccatcaatagtgtcatatagggactaaatatgttttttgaaaagaaaatcaaaataatcctgcattaaactgaattctgcacagggaagttttgctatactgcaactttttttttttttttttgagatggggtctcactctgttgcccaggctggagtgcagtggtgcactctcttcactgcaacctctgcctcctgggttcaaagcgattctcctgcctcagcctcccgagtagctgggactacaggtgcctgccaccatgcccggctaatgtttttatttttagtagagacgaggtttcaccatattggccaggctggtctccaactcctgaccttgtgatctgcctgacttagcctcccaaagtgctgagattacaggtgtgagccaccgtgctcggccatatactgccacatttctacacagttatatcaaaagcaatccatgtttatggttttaaaaaaatgaacagaaaagaaaaggtaatgactttgcttacttttattttaaattctgttagcccttcaatgattagtctaagtgatgtgtttttctttgcttgagatggagtcccagtctgttgcccagactggagtgcagtggtgcaatcttggcttactgcaatctctgcctcccgggtaatctcaagtgattctcctgcctcagcctcctgagcagctgggattacagctgcatgccaaaacacctggctaatttttatatttttagtagagatggggtttcaccatgttggccaggctgctctcgaaatcctggcctcaagtaatctgccctccttggcttcccaaagtgctgggattacaggtgtaagctaccgtgcccagccaatgcgtttttatttctagatgtaccaactttagacagtgcctaatgatttctgatatgaaagacaagaggcaaggtatttaatagtctcccctcccttataatttttattagttctgttattatttttagtgcctctagtgggcatttgtaactttaaatatatttaatcttatttctcttgattaatcaccttctgacagtatcttttctttcataccatgtaaaatgaggaaactcacccatctatccttccctcccacctccccgctcacagctatgtctttccttttatatcaccaagatttaaaatattcatactctgttcagtaattattgagtcatcctccttaatactaatttagttaataatttaatttttggtcttgcctataggtcaagtaaaaaatcataaaccaataatgagaatttgcaatattgtgacaatataaatattagtcactaaagaagaaagcagcttgagtagacctgaacaggaggcaatgtcactaaggtagaatgagtgcaaatgttcccgacatttatgtcaaatgaattctcattgttatgttctaccacgtcacaggtttgtctcaagctaaggttatgttctccctaaaatactgttaaatagagcacgcatttagtgaacataaaatgtatatttacatgaaatgtatatagacactttcaaagcattaaaatgaatgaactgtgaaaacaccttccaggccagggatggaacatcatcgaaagtgccttcactggctcccatctcttcccacccttcccaccagctattggtaaaagaattgtggctgggcacagtggctcacgcctgtaatcccagcactttgggaggctgaggcaggcagatcacgaggtcaggagattgagaccatcctggctaacatggtgaaaccccgtctctactaaaaatacaaaaaaattagccaggcgtggtggtgggcgcctgtagtcctagctactcgggaggctgaggcaggagaatggcatgaacctggagcttgcagtgagccgagattgtgccactgcactccagcctgggcaacagagcgagactctgtctcaaaaaaaaaaaaaaaaagaattgtgtgttaatcattctctttgttttctggagagttttttttttctttttaaccgcctatgtatgtattaataaattaactctgttttggtagttgttgtttctaaacttcatacgactctaatcatacctaggcattcttctgagactcacttctatcatgcagtgttatgaattttagatttagccatcatcctgcatgtagctacagtttgttcatcctcactgctgtgcaatactttattgtataaatataccagtttcttatttgttcttctcctgatggacatttagatttttgccatcatgaacaatagaactgcaaacattcatgaacacccttcctcatgcacatgttaggagttctgggccttaagacttccatatggccaactttagcagggaatccaaaactgatttccaaattaacactccccagacagtatatgagacttcaaactgattcacatccataccaacacttgttatgatcaaggttttaaagttttttctaatttaataatgtagaatataattttgttgtggtgtctgcatttctctgagcactaatgaggtaaatattttgtacttgctcttctgtgtcatttcttaaaaattattttttagtattaatttcttattcatagaaacattttattgtctcaataagagtcatacatatagtcgtgtgtgtgtgcgtgtataacttttcaatacatatataaaacttggccgggcgcggtagttcatgcctgtaatcctagcactttgggaggccgaggcaggcggatcatgaggtcaggagattgagaccatcctggctaacacagtgaaaccctgtttctactaaaaatataaaaaattagccgggtgtggtggcgggcgccttgtagtcccagctactagaaaggctgaggcaggagaattgcttgaacctgggaggtggaggttgcagtgagccaagatcgcgccactgcactccagcctgggcgacagagcgagactccgtccaaaaaaaaaaaaaaccaaaacaacaacaacaacaacaacaaaacttttcccagtgttagcctttttattttttctattatctttggataatgttaagttcttaattttaatgtactcaaatttatagataattttctttatttgacactttttgtgatttaagaaaaacatcagaaaaatgttttatactgtcttctaaaagtatatacttttactgatttttaaaaaatacctggattggtttttgtatatggcgtggggtaggagttaagtttcgtttttctccctagaaataaccagttattatggtacttgaagtccattctttctctattaatctatatcatcatctctgccatgagtccagttttcatacgcctgtggatctgcttctgggtctctactcactcactttcattgctcaatttgtctattactgccctcattacttagctttaatatatatttaaaaatattcgtaaggcaaagctccaaccttgctatttaggaacatcttggctattcttagccctttgatctattgtataaatttgagtatcatcagtttgtcaatttccacatacccaaaagttggaaatttgattggagctgtattaaatctatagatatctgaagagaacttgtatctttacaacactgcatcttccaattcatgtacttggtattaggcgtctccatttattttgatatttcttaacgtatttcaatagtttgttaattttctccatagaggtcttaacacatctcttgacagggttattgcttagtaacttatatttttatactaatattaaaagttttaaactataattttcagttgttagtgtagggaaatgaaattaattgtgtatacagcaatcttgctaaattttcttattaatcctaataatctgtagattcttttgagttttctgcataaacaatataatttgagaaaatgaatgttcttctcctttctaacaggtacttttttttcttaatttattgcctcgaccaaggatgtccatccagtataatgttgcataaaagtggaactcatgtcttgttcctcatcttgaggggaacgctgcaaatgtttcaacactaaataggattcttgttttgagtttttttggcagatactgttattgtgttaatgaagtgggcttctattcctgatttgctatttttcctttaaatcatgtatagtgaattttatcaaatgctttttcttaatttattgaaacaatcctatttttcttttaatattttaatataattaatcatgttaatattataaaaaggatccaattttgaattcctaaaataagtacagtttcttaattatgagttatattttaaaatatattttgtacttggctggatggaatttacaaatatttgacctagaatttttacatttatgatcatgaatgatacctgtgaattctttttcttgtactggcttgtcaagttttgatatcaaggttatactgccttgatataatgagttgagaactgctggctttttctaattctctgaagaagggtgtaggtttggaattacctcttcctgtgagtttggtagaattcttagtaaaaatgtctagccttgaaattgtgtggtggaatgatttttaaaaaattactgggccaattgttaaaacggctataggattattcaggttatatttatatgtaaatttcatataaaacatatacatatatacatgtaatacctgaaaaatcattttaatcatagtcatttcgtctagttttgaaaaaattttggtataattttgcacataacatatttttgttcttgatctgcatcacagtttattccctttttgattcctaatattatttatttgtgccttttctctttttgtcctgatcaatctctctgcaaagtttgtcaactgtattataacttcattgaataaacttttggctccattgacatttaaaattttatctctgctattttattaatttctgcttttgttttttttttgtaaatctcttttccatttgttttgggtttattttctcttctttcagctcttaagatagatgcttagttcattaattttttgtttgctagtatgagtcatttccttatttatttagagacggagtctcactctgtcatccaggctggagtgcagaggtgagatctcggctcacagcaacctccgcctcccaggctcaagcgattctcctgcctcagtctcccgagtagctgggactacaggcgcctgccaccacacccagctaaattttgtatttttagtagagatggggtttcaccacgttggccagactggtctcgaattcctgacctcaatggatccgcccacctcagcctcctaaagcactgggattacaggcgtgagccactgcacccagcttctagtatgagtatttcagatgcaaagctgcaactttccctctaatttagtttcttcctccagttttaatattaggtatttctattacctttcagtcccaaatatttactaatatctagagtgattcttaatttctaaacatgtgttttccctcctagtcatattttcattatcaatttctaatttaatcatactgtggttggagaccatggtaaatataatatttatcttttaaaatctgttgaaacttgctttatggtccagtagttgtcaattttcataactgttccctgtctgcttgaaaataatgcatattctgcagctgttgggtaatgtactcttgctcattgtgttgtttaaatcttatgtatccttactaatttttctgtttgcattatacaacagttacgaatttctgtttacatcttccattaagataatacatttccccttgtaatttgtgacttttacttttaaaaatttgaagctttgctatttggaatttacatatatcaaattattttgtccatatggtaagttgtatctttccttgggtagtgaccctttttaactgtagtaatgctttttgcttaaagtttatttttctggtatcagaataaacatatcatgcttttttatcaccagtatttggctggcatatattttcctaacctttttcctttcaaattttctgaatctttaatttctaaatgtgtcattgtaaatagcacagagctagagttttattttttaaatcaatttggtcaatatttgttattgaatcattgcatctaatccatttgtttaaattactgatttttttttttttttttttgagacggagtctcactctgttgcccaggctggagtgcagtggcacaatcttggctcactgcaacctccacctcccaggttcaagcgattctcctgcctcagcctcctgagtagctaggactacaggcatacgccaccacgcccggctaatttttgtatttttagtagagatggggtttcaccatgttggccaggcttgtctcgaactcctggcctcaagtgatctgcccacctcggtctcccaaactgctgggattacaggcgtgagccaccacgcccggcctttaaattactgatttaatttatgctaccatatttttccatatactctgtttcattttctcttcttcaattcttttggattaactaataatattcatattctatttttagcttggtttgtaagatgttctccacatttagtttgtaggttaaataccttttagtatagtttagtgggtaccctacaaattgcaaatatttacttaatttatcaaagcccaaagttaaaatttttatccttctccaaaataattacaggaacttagaagattttaattccacattctcatcttattttatgctattgttttgtggattccaattgtatttattttgattacttaacaatatattattactggtgcatgcaatcaacattgtttaaattttccccatatttactttcactgcatttaatctttctcgcacctcacattccttctgaacaaagtatgtcttttaaaatttcttttgtgaggatttactggtggcatactttcccagcttttgtctgaaaatgtcttgactcattaaattttttttttgcaagatacacaatcctaagctgatagttattttttcccaactcagtgatgcttcagcttctctgtttgcaggctcccactgatgctgttgtgaagtcaggtgtaagttggttgagttgttgaagatattaaagggtattttaatttttatgtgcactttagctataatgtgtgtagtgtggacttttttttttttcatttatccttggtattcactgggtttcttgactctgtggattaatgtctttcaagtctggaaaattctcagccatcaatcatcttcagtactgtctcgcttccctttccctttctgaaattctagttagatgcatgttagacttccccactttatctccatgtctcttaactaatttcctgttttccatttctgtctctctaggctgcattctagataatttcttaaattcaactttccaattcattaattctttctcagctatgtctaatgtgctgttacatctgcccatggaaattctaattcctattatattattttattcctagaattctgtttaacactcctccaagttttcttgctctttaccacatttccaatcctctcttttatttccagaaattaaagcaagggctctaatttcacattctaggcttgataaccccagtttctgaattaggagtctgattctccgctgtcctgtttgttcttgctcttgctcgtggtctcgtttccttttttgtaaggggttcttttctgattgtaagttgctcatttcccttagtgctctatttctgttattattcattcctctccattttctttttctgccaccttgactggctgtgtatcttcaatccctttcatattttccatctgtgttttgctttatactcagaaaaaaaaagttttcaactttatattcaacgtttcagacttcagctattatcatcccttctattgtttgtcaatcatatttttaattctcaagtgttcatttgttctgtaattacctctttttcataccaatctgttctctttttatttaacacaaataatttcaaatctttctaaggactgcaattatacttgaaacttttttcttctttaccttgaattagatttcctagatttcctttgggactagtctttctttttggcgtcactggttatatattcatatttttaaataaaaaattggttaacaaaggtagttggcgtggctttcctgtatcagtattccgatcaatttttctaacacacctatcctttgtagggaagagctgatttatggctctttgtaagtgggcagggtatgctgatgtgaaggattcatttagggctcaagagaagagaagcctccaggcaagctgtaagcccaagcccttcctccacccactcctctaagaaaaatataaagcactgtactttaggtgtatagaatttttgtttatttcccttgagaaatagttgactcttctgccattactccatgtcatctatttttaaggtctggtactatcttagaatgtattctgtttctctctttggtattagttctcagtgaggagtgaactgttcaattttttttttttttagcaaatattatggtactttttgtttttgggggtttttgagaaaaaatcatcctgaaagctctgtgtgggaatccgtgaggatgggggtggaggggtaatggttgaaggatggccaggtgttcccatcactgcaagcaattcgcacttgttctctcttggggtccagtggaaatgtggtctttcctggggctcctgggggctgttcccaccaccactaaaacttgttcctgtctgattcttcctttgctgtgtcacgaccttccctgttcaggggtatttttcagtagggttttattactttcggctttccagaacacaactaaatttctggtttgctgatggcacttattctgatggtgctattttggatttatttccatttctacagcttcatggctattaggtggggattctgaaggaaggggaaggattgcttaaatgcagtcactcaactgaacaggacgttctcataatttttaaaaatgtagacataaatcatccatgttaatattcaagtatctcaatgcttaataagcttccattttataatatcaagttcaattgatcagtaattcagcaaacgatctaccttttaaaagatttgtattgaaagtcattttctgtttatacaatctttcctttagtatctataatacagtctttctcacttcaaagagaatagaagcactggcctaaaataatgagttagtaatcaatccacacagatattttgtttttggtttctctgaagctcagtatttctctatttcttttttttaatttttattttattattattatactttaagttttagggtacatgtgcacaatgtgcaggttagttacatatgtatacatgtgccatgctggtgtgctgcacccattaactcatcatttaacattaggtatatctcctaaagctatccctcccccctccccccaccccacaacagtccccagagtgtaatgttccccttcctgtgtccatgtgttctcattgttcaattcccatctatgagtgagaatatgcggtgtttggttttttgttcttgcgatagtttactgagaatgatgagttccaatttcatctatgtccctacaaaggacgtgaactcatcattttttatggctgcatagtattccatggtgtatatgtgccacattttcttaatccagtctgtcattgttggacatttgggttggttccaagtctttgctattgtgaatagtgccgcaataaacatacgtgtgcatgtgtctttatagcagcatgatttatagtcctttgggtatatacccagtaatgggatggctgcgtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgctcactttttgatggggttgtttgttttttttcttgtaaatttgtttgagttcattgtaggttctggatattagccctttgtcagatgagtaggttgtgaaaattttctcccattttgtaggttgcctgttcactctgatggtagtttcttttgctgtgcagaagctctttagtttaattagatgccatttgtcaattttggcttttgttgccattttgacatgaagtccttgccaatgcctatgtcctgaatagtaatgcctaggttttcttctagggtttttatggttttaggtctaacgtttaagtctttaatccatcttgaattaatttttgtataaggtgtaaggaaggcatccagtttcagctttctacatatggttagccagttttcccagcaccatttattaaatagggaatcctttccccattgcttgtttttctcaggtttgtcaaagatcagatagttgtagacatgcggcgttatttctggaagcattccctttgaaaactggcacaagacagggatgccctctctcatcactcctattcaacatagtgttggaagttctggccagggcaattaggcaggagaaggaaacaaagggtattcaattaggaaaagaggaagtcaaattgtctctgtttgcagatgacatgattgtatatctagaaaaccccattgtctcagcccaaaatctccttaagctgagaggcaacttcagcaaagtctcaggatacaaaatcaacgtacaaaaatcacaagcattcttatacaccaacaacagacaaacagagagccaaatcatgagtgaactcccattcacaattgcttgaaagagaataaaatacctaggaatccaacttacaagggacgtgaaggacctcttcaaggagaactacaagccactgctcaatgaaataaaagaagatacaaacaaacggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctgtaggcatcacactacctgacttcaaactatactacaaggctacagtaaccaaaacagcatggtactggtaccaaaacagagtatttctccatttcttacatgtttactggaatcatgattcctaaccatatacaaaaacagcaagggaaatgctggtggggtcagttctcctaaagtttcaaatgtgctgtaaattgcagagaattctcagacttaataggaatattatttttgtatacatgtgctggggttttggagaaagatttatttaaaaatgaaaaaaggccaggtgtggtggctcacacctataatctcagcacttttggaggccaaggcaagaggaccgcttgaggccaggagttcaagaccagcctgtgcaacatagtgaaatgctgtctataagaaaaattttaaaaagtggtatgtgcctgtagtcctggctacttgggaagctaatgtgggaggattgcttgagcccaggaattcaaggttatagtgagctataattgtgtcactgtactctagcctgggcaacagagcaagaccttgtctcaagaaaatgaaattaaaaaaaaaatccccttactcctagaaaagaaaaagccaatcaaaaacctttcttggacaatgaaatgccagagggttttataccacacagggatagtgccacatcatgtcttgtagaagaagcatccgtttttatagaatctaaattgcagtgaatattatagcatgccataaaaatatgccgggtgcacacagaaatcacagcagacagtccttggacaataattcaatctcacggtgaagtgatagcagcagctttctgggaatcaacagagtgggatgaaaagctcgtgtctttggggcagagagccctgaattcaaattctagctgtcatttttttagccaggtgattaaaaaatgactcgttattagcctcagaaactcatcttcttcatgtgaacactgagatcatgcagctcatgcagctattgtaaagattaagtgaaatactgtaagtcaggacgctagcgcagaatagacactcaacaagaatttcctttgctcttctgtctgtcaaaaatgccaagctggcagaaggtgcatttattcatctgtgggattccccctttaccctgaacatttaaattcaatggtgagacacagggaggaaagcaagggtaactcttcaagacactctagtctgtggtgtgcgatgctgacgtctgtataccacgacgtggacttaaccaagtgtttcttctgatctcttttcttaggactaaattcatcattttcttcagatttcatgtcttttgtcattttgcctcatcgctggtgcctgtacccacagcaaatcccaacagagggtgggataattaagtgatattgcctccgcaccactgtgccatcaccccctccaccggcctttctctagctgcgcatgaaaattctgctgcttcccagtgcatttgccaggacatcttttctctccggcccatttgcctcacagatgcccagtggttgagcctcagttccacagacagatctacagctcagaggatgttcagtcttcaaatgcagctttgtaattggcaaggggtgctcttagcttgctggctggtcgtgaaactaacaaagcccagtctttgtgagtgtgcttttaggacacgagcagggtagcttatgaatttttaatgctcaagccaacgttaataccaattagtagtgccaaagaagagaattaaaacactacttcatggaatgatagcatcctctctttgacaaaaaagcccatgtgttttaatagccaccaattcaataaggaaactgcttcttagatagttgagtctgtctatttctggaagagggcacagtacatatacccagccggttgtgacttttcttcatggattctaaggtcaattatcttaaggtctactgattgattttctttgcccactcattttcctttaatttagacaaccaattatgtgccttttaagtttttttctccctccacatatactaggaacagccataataaagcatgaagttcctttctcttgggatggctttgaaattcaccattttctgttttggccttcctttccttgaatatgcacacttaaggtcatcataaatcttattcatttgggcagcacttgaacaaatggcccctttccccagttttttagtgaatttctttgaaacctactgtccaatgtgtgctcatcctccctccccttctgccctctgcccccaccccctgctccccagatgaaactccagagcgaagtctttcttacttggattattgtgtccagaggatacaagctgagagtcctgaaagaacaagaaatatcaattaattttcttattttgactttcaaaatccaagttaaacatgagatcatgtttaaaactggtcattcagaaccgattcattgctctcaatctctatcagctactttaatgagaaacatatacatgaaggtggacacatacatgttaagcagttctgggaatatacttcacaatcatttttcttttgtattaatgactttctgttttgtttattgaggtgaagttcacataacattaaaattaaccattttaaagtgaacaattcagtggcatttggtactttcataaggttgtgcaaccactacctctatctagttacaaaatatttccatcactctgaagtcaaatcccttacccattaagcagggtctcccatacccctgccctcccaatgccccagcccctcacaaccaccaatttccatctgtctcttggatttatctattctggatatttcatataaatggaatcatacaatatgtgacctttgtgactggctttttacttaacataatgtttttgaggttcatccactctgtagcatgtatcggttcttcattctttttatggctgaataatattgcgtcacatggatatacaacaatgtgtttatccattcatctgttaatgggtatttgggctgtttctaccttttggatattgtaaataatactgccacgaatatgcaggtatgtacactagttcgagtccatgttttcaatccttttgtgtatatacttaggagcagaatttctgggttatataactctatgttaaactttttaaggaactgccaaacgattttccacagcagtgaaaccattttgcaatccaacaatgtttgagggttccaatttatctacacccttgtcaatgcttgttattttccattaaaaaatgatagctatccttgtgtgtatgaagtggtatctcactgcagttttgatttgtatttccctaataactaatgatgttgagcatcttttcatgtgtttgttggccatttgtacatctttggagaaatatctattcaagtcctttgccattttttaattggtttgtctttttgttgttgagttgaatgagttcttgatatagtttggatactagactgttaccacatttatgatttgcagtatttcctcccatcctgtcaattgtcttttcattttatcagtaatgttctttgatgcacaaaagttctaaattttctaaatttaaagttctaaaaatttttaataaagtttagtttacctaatttttcttttgttgctcatgcttttggtgtcatcgctaagaatccattgccaaatccaaggtcatgaagatttaaacctatgttttcctccctgatacttatggtttgggttcttatactcatgccactgacctattatcatattgacttttaatctaacttttctttgaatgaacctttactgccacccatttcctgtagatgggtttggcaatcatcccaccagtaacactctattaaacaactgttgtcaatctcacgatggtggataaaaagattagtatggtatctacttatctgcaatggaataaagccagtactacacagtattttaagtttagttattgctcaggtaaatagagattgaatttgattttacttgcattaaaacaaaatgttaaaatctgttttgaggatttacatcctctttctttgcaaaattctcatttaatagaaagtaaaccacataccatatgttcttataagtgggagttaagctatgggtatgcaaaggcacatagagtgatatgatgaactatggagactcagaagtgggaggataggagtgggacatgagataaaaaaactacatactgggtacaatgtacactactcaggtgatgggtacactaaactctcagacttcaccactatataatttatccatgtaaccaaaaaccacttgtaccccaaaagctattaaaataaaaaaaatttaaatatgaaagacttacacaagaatgcgtgaataggaatgtaaaaaaaaaaaaaggtagcaggacataaaatccagcaaaactcctttaaaattttggcacatggaacaaaaatccattgaaattgaatgaacttctattacgtggcttaatgtattttaccagaattttgttccacgagtatagctgttatggggtaaagggtgtcatttgatgtgacttgtgttatattcaaatccaagtactaatgtctgctttaaaaagaaattctactgaaacagtataaaatgagccagtcggtgggcagaggttgggtaggaaaattgagacgggaagggattcccactctattaaacagcctgagtcatatgcagatgcctaataaacctctttcaattatggtaataatgagctattcaactgaagaaaaagaacaagctcaactctcaccctgagattcagtttttggaaatgattatatgaagatgaaatatcgttcctgaaatggactaaaatatcatctgtaagaatgattttggcctattttggatagatgctgtcactaagaagacatccacaattaaatcccccatgtagattggtacgttttccttctcttcaagggaattcaagagtttatatctggacataagttagttttaactttggcacgtgaaaatactttgagtcccatttagttaactctgctgtctgtagatctgggccatttggtggcatctgtactagggaggggaaatacacaccatcaaatggacaagaatggtaattgacatagtttccagcattaagcttatttaaaaaaaaaaaaagaaaggaaaaaaagaacagaattttttctaagactgttaacacaaaatataattattttatttacttatttatttatttagagatggagttttgctcttgttgcctagtctggagtgcaacggcacgatctcagctcactgcagcctccgcctcccaggttcaagcaattcttttgcctcagcatcccgagtagctgggattacaggcacctgccaccaggccctgctaactttttgtatttttagtagagatggggtttcaccatgttggccaggctggtctcaaactcctggcctcaagtgatccacctgcctcggcctcccaaagtgctgggattacaggcttgagccactgcgcccggcctatcttatttattttttagagacagggccacattctgttacccagtctggagtgcagtggcacgatcatggctcactgcagcctcaaactcctaggctcaagcgatcctcctgccttcgtagctggtactacaggcacgcgccgccatgcctagctgaaattgttaatttcttggtatgtcctaaaacccacaggatgattgttgatcacaagcagagaaccagagatgagcttacagatgacctgaattaggattacaaaccataagatcatgtatcccatagatagtaaactttaaattttaactaaaacacctgtgtgattaataaccattattatttctgttttgtgtgatagggagtgaagagagacttcaaaatggttgaaataattggtataaaaaaaatctctgtggaagtcttctgtaggagaggcaagaataaaatcaaagactttgtccctaatatatactctcatgttgctagctgatgttttcttggtggtacattgaaacaacaactgctagtgccaaagtaattggctataaacccagtgttctaaactgtgccactctgcgggtacaaataatgtcccattatcattcttaccggcatttggccagcctgcttgtggaggggtcagctaccttaccaggccactcccacattttaggtcctcttatcagacaccctgataaggtgtctgctggcaaacctcgggtcctggggctgcagcttttgaaggaggactgttcttcccagccagctgcaaaaccccaggggccccacaggctatgcagctctcttattcttcacagagccagagcaaggctgggtccagaacagagggagaccaaagttcctttctccaaagggaccacacactgaagtcctttccacttttgtgtctcctgccaccccatccagatacctacatatgtgtagcttctgtctcaccagccttctctccccttgcaaatgtcttctgtaggtaggtgcctggggaggtccagccccatctgtgcattggtattgtccccctctgggagcactctactaggcctgcaagattctctactaggctttttaagggttacagaagtgagtccagcaagttagcggtggaggtgacatgtgtacaaatcattagagcccaaggctgaaagtgatgtggtgactgccactcccaatacttccagctgtgtatcctgttctgatcccctccccctggaatgctcatcctgctgctttctgtttcctgcctggcaaatttcattcttccttcgaggctctgcacaggtaaactcaagggttaccctgtgctttgaaaccttcttgactctaatgtttttgctacactgtgtcatacttccattacagtaattattttttcaacaatgactttaaaaaaaagtataagtgacaataacacaaaccgtacatatttaaagttaacaatttgataacaagtctcacatgaggaaggctaccattattactttcttgacccaaggatggctctgtaacacctattcattgacgaaaaatcagcaaaagtgttagctgccagcccctggaaaccacgattctcctcactgcttctgtgtgtcgattttagattctacatataggtaatgacatctagtacttggctttctgtgtctggcttagttcacgcagtacaatgtctatgctgtgtgtgtgtgtacacatatgtgtgtgtatgaataatatatgatgtatcagaaatgtgactatagttaacaatgagggtagatctttagaaatttattaggaggtaatgttctcatcaccaaaaagagaaaagaaaatggtaactatgtgatatataacttggtaactattgatatattaattagcttgattgtggtgattatttcacaatatcaaaacatcaagttgtttaccttaaatacatacaatttttgtcaattacacctcaatagagctaaaaaatgaaatttttgtactaatgatttaaagtcttaattttacctcagaagtcaagtcattacttgcacttaagcatctacatgaaacaaaacagaacaaactggtacaatatttttggaaaagtcgtaataaactgtgctttggtatgtgcccagttatatcaaaagttgtacttataccatgatacctacacataacaaaaatgtctatgattctattttgggtctggattatcttggctagattacgtgcaaagattctaagcattgtgcattttattctaaggatggcagggtgccactggaagtacacactgaataaactgttcagttaaattcccctgtactcaatggaagggctagaagcctgggaacttcacatgggttctgatgtcaattccaccaatgagatgccacatttcattcactgaggtgttgcctacaaagccttaactatttactatatgatccttcactgaaaaagcttcttgacctctgattcgaacaatgaattcttgggaaagaattagataaacatgtcgaaaaacagaatagacagtccggagacaaatccatgtatttatgagaagctcaactattgacatagggtatttcaaaccagtgatggggtgaatgggctattacactgatagtattataataacttactgaccattgaaaagaagaaaacaagaatcctacatcgtaacatccacaactaaaacaaagtataagagaattagaataaaatagaggacacttagaatattggagcaggaaagatcttttttctctgacataaaaattaaacactttgctagtgtaaaagcacataaaaaaggtttgcaagaaagtagttgtatcatatataatagataaatgaataagagttaaggagttcctacaaattagtttttaaaaagtggtaatgggtaatgaacaggcaatttgcaaaggaaaaacagtcaatgctcaagcttagaagtaactgggaaaatgcaaatgaaaacaacaagatatcaacttttcattcatcatacagacacactgataaaaaacccagatgataataatcattggcaaagatatgtaaaaagtactttttttttttcttttcttttttttttttttgagacagcgtcgtgctctgtcacccaggcgagagtgcagtggcgtgatcatagctcactgtagcctcgacctcctgggcttaagtgatcctcctgctacctcagcgtcccaagtagctgggactacaggtgtgccaccatgcctggctaattttttcatatttttgttgagatggtgtctcactatgttgcccaagctggtcttgaactccagacctcaagcaatcctcctgccttggcctcccaaaatgctaggattacaggtttgggccaacacgcctggccaaaagtactcttgaaacacaatccaaagtaactgtggcttctgatgcccagaaccacaattcctactcaaggtatccttattagaggcattcaaagaggcatttgatctaacagtgtttgtaataataacaagccatacataatctcagtgtccactgaaaggaatctgattaaattatggtaaatttatacaaaatattttgctgctgttttgaagaatgaagaaaatctctatatattcacttgaaaaggtcttcaaatacgttttattgtaagaaaaatcaactcttagaatggaatttatctttgtgataacagcatgaacaattctttcaataattcaccttagaaagcggtgatattgacagttatttacttttttgttttgtttgtttttgaaacagtctccatctgtcacccaggctggagtgcagtggcacaatctcagcttactgcaagctccacctctcaggttcaagtgatcctcctgcctcagcctctcaagtagctgggattacatgcatgcaccaccatgcctggctaattttgtatttttagtagagattgggtttcagcatgttggccaggctggtcttcaactcttgacctcaactgagccacctgctttggcctcccaaagtgctgggattacaggaatgagtcatcatgcctgaccagaaagctgtgatattgatatttagtaacgatacatattgttgaaaaaaatcaacttttggaaaaaatgctcttactatacaacttaggaattggaaaaatatacatattttctatatataatgcacagggaaaatgaaatggcacataaactcctgatagtaatctctgggtagggaaataatctctggcttggagtgccagggatgttgagattttggtctcttcccatttgtataatttgatccttcataatgagtatgtagtatgtgtcagttattcaaatcaaagaaagcctattagactcatgtatatagtcatttattttgtggccaattttttggtgtgcttttccttagaaaatatagatatctttttttaagtcctagaaaatatcttaagctttaaaaaagatattcagggaaattaaataccacacgtcttcaatactaagacattgattttaagatacatcattaatttaataatagcttttcagaaaaatccaggacatacaattttatacatcacattgaatgtttaaaatgattataagatgcatttcaacttcatgaatgttttttagacaaaatgataattacagtagtatcacattttgcagagaagtgtaggtaagtaagattggaggcttgattctccccctttcataaatgaataagtatgcgcttgcaaattgtgaaggatcagattcacgtgcctctggcaggaatatttacagaagaaaagacaatcacgggtaaagcccactgcccactagaaatgcctgcatgagtgaaacatattcctcctgagggatgcaagatctcaccttatttggaaatggaaatttggttggttccactttgccaggtgcttgaatagcagaaagtggtggaagccaggtcatctcctgaaggacgggataaaaacaaacaatattgtgatacagacagtatttaaaatcagcggtatgtaaagcagctgtacaagtgggccttcataaggcagggaagggttaaaaaatgtacaaaggctgaaagaattttaaaaaaagatgtgaaatccacttttatgatttcatttcctaattttaccaattcttgactccttggctctccccatgctccctttataccttaaaaaagtttgcaaggctgtcctattttcacttcatttaaggtcctgagtaaagggacaatctagtagcaaaagttctatggaaaatgccacatgaaggggactcggacttgatcccacagaattcacagggtgtctccaaagaaatgcataaggtacttttaactttatgaatctttattagaggagttatttatacaattagaaataaagtatcagttctcaataaggcccacacatcactttggtcttcataaaatgtcattcacggagagtgaaaaaacaaatcacgcctatgaaatacagagacagaatgatgtcatttcttataacacagtattaagaacacaacatgagcttaacatggaataatttctcatccactttttgacacactttctctaagccttgggaaagggagagaggggttgttttattcacttccagtattcaccttcagtttcatctctggaagggagttccaatcaataaatgattacagaattacattgatttctgatgaccaggacgccaacttggagtttacgaattagatgtgaaccctattattattattattattattttttgagatggagtctcactctgttgctcaggttggagtgcagtggcgtgatctggctcactgcaacctctgcctcccaggttcaagtgattctcctgcctcagcctcctgtatagctgggattacaggtgcgtgccaccatgcctggctaatttttgtattttcagtagagatggggtttcaccatgttggccaggctggtctcaaactcctgacctcgggtgacccgcccaccttgggctcccaaagtgctgggattacaggcataagctactgcgcctggccgaaccctatttcttgatttgcctgcacttccaaacctaagcaagcacagaagcagtggtcgatccattttcagaaaagtgagaaattctctcgctcgaggtgaggacatttccttacctccctttggcgggtgggtgttgaaaagcgattctgtcaggcttttggaaggaaagagctcttgggaatggtcgggcaccttcttttcttgggtcattcacctcccccagcacctcagatagtgcagaacccacacaggaagccgtgggagggcgagtgtgttcaaagccatgtgggaaggatttactgaccccatatcatctctcccacaccacgacacgtgacacagacagtaggtgggttaggcacatacgcattctaggtgtcccttctccattctggtgttaccaaccaattgtatacaattttatacatcacaaagcaaagcaaaggtggatccagtgaccctttaaactgtccctctctcctcccatctctgccctgctggtgccttggtctccctttgaggaggctgataagcaggactgtcaagtttgcgtccacagtggcatctttgtccatggagtcaaggaactattcgtcattctcagagttgggccaccttgtctaggacctggtcagctcttacccagagtgttactacccgattaagaaagccatgaagacacaagtgggttttccataccttggctcccccatagggccatctctcctctacaaggtttctgattttatccttccattttcattactggagaggatatgtgattttgctataagtggcttcaaatcttctgtagagaaattattcatcaattacaaactattaaaccaattgtccttttcctcttttgttgactgtctgatgtgtccctgagtccatcccactgctaatcagccactcaatagcttcctttgcaatcactctttcgcttacacaatttacattgtctgatcctcaggggacaacattgcgaagtacaaactaattactcatgattaaacatcagacttacacataccaccccggtatgtctatgttaactttgcatacagactccctctgtgtatcagaatgcctcacatttgtgcaatttttctctgactgtagctaaaatccaaaaagataaactattatttcagcgtgtcctccagcaactcaagaataaataaaatgaaaagtccataaaaaatgagtaacagtactttcaaaagaacacttcctagaccaacagcttcttacaactgacactttcaggttcaaatctgtttaatacaccgtttatccaagagtggaatagcagacaaactttgagataccactaagctgtgattcttaagggtggaaactgtcctcctgatcttcgtaccttaatcagggtccatccctgagcacccactcatcccctgaacatttcctgaaaacttaccattggcaggcactgtaactgtgtcttatgtacacgaagtgctcagttcagcatctactgaatttgaaagttagggtatcggctctggctgtgtctattatcagtctttcttctctaattccagctatgcttgtaatcaatctttccatttctttctttcttccttccctccaactcacctattcattaatccaataaccacccaacctcaaaagcaatatccacagaaggcagatgacacattctcttagcttgctgtcctcatgcaaataccccttctcctttgaagctcttgccaggtggttttggaccctcactaaagatgagctgcatctttttctgtccactccactcctttaaatcagactaacggctccctccaaaattgcctcctgccctccctaccttcatgatattttcctatttttttttttttttgagctggagttttgctcttgttgcctaggctggagtgcaatggcgcgatctcagctcaccgcgacctctgccttccagttcaagcaattctcctgcctcagcctcccgagtagctgggattacaggcatgcgtcaccacacctggctaattctgtatttttagtagagatggggtttctccatgttggtcaggctggtctcgaacttccgacctcaggtgatccgcctgccttggcctgccaaagtgctgggattacaggagtgagtcaccgcgcccggcccctattggttttttaaaggcaactgggcaatcttatgggcacccccaagcatttcttttcaccttcttgacatgttcttcttctgagtccatctctgctcccctcaaatttttggcttcacaaccctgactttaactctgatctttggacttcgtcttgaagattcggaatcttggcttttcccagtctactctgagccagctcattccagggaatcgccaggccctatttctcatccggtaaaaatcggcatatcaaattgctcttgaaattcaacacccaacactagccaccttgcagacatcttagctggcttctcctacacaaggggagaatcaatggtaggtccatacaaatctggatcaagccctcatgtctccatttttggaccaagctctcattctggcttctctgattctatacttgggctccttaggaaaggtaactgtgcacaatggtgggatacagaagtaggacacggacttctctaaacttgggccctcctttccttctcctttgaggctcttgccaggtggttctggatcctcattaaagatgatctgcatctttctctgtccactccacccctttaaatcagcctaatggctccctccaaaatcgcctcctgccctccctaccttcatgtctttctattggtttttaaaggcaattgggcaatctggtggtggcttgggccatgtggcttgggcaatccttgaattcattcctagtctgttcctttttctgagttcctcaaacattctttccacattggtgatttttcttgagcctcactttgatccctgctttctcacaacaggtgaccctgcctcctatggcactgaataaacaaaggctcttaagtgtaaatgtttcccaaggacagacctgtgggtgttcatgcctgaccccgttgccttccttctggtctgactggaagaggcatgagttccaagctaatacctgcctgcaccctctgtctgttactctgtccttggggatccagttccatcagtatctcactggtattggtttaacatcaatctttccttctccactggctttttcccccaagactgacaaatgatctcaggcctcagcccttcctgacactgtattcctcctccagctgatcttcatttctctatttctcttgatagctaacactctcaaagaagtctttatacttgctgttttgacatcctcacctaccatttctatttttgacttaagattttttgttgcagattatacacataagagtccatataatattgtgcatgtgtgtgtgtaagcttaagattaatgaaacgaatacctgtgaactcatgacccaccttcacatttccaagaccttagcaaccactttcaatagaagcagccctgacataactccttctgttgtcaagggcattggatttccttgaatgctcatttccccctgactctcttcccccgtggctcccacgctgtcctcctggcccagctccactctcggagatctcatgctcattcttttttgctgaaacttcttttctctcactgttccttgggtgttttgtgttcagccttcctctcactacccttctttccctggctgatcttgctactgtggctttaaaaaccatgtggtatgctggtgatgcctaaaagcacatccaggtctaacgtgcccactctagatgtctactgagccactcaacctgggtgctcatgagcgattcaaactcaccatgtttaaagctaaacttacacgccacacaaacttttcttcttcttgtactttatatgctggttaatggcagcaacatctattaactcttcaagtcagcatacctggagttatgccagattccttctctttcactccctctctcataataataacaataattctcatttattaagcatttaaaatatattatgcacgattttaaacgctttatgtgatttgcttaattctcatacccaccctgaaaggtaggctttattattttcttactttatagatgaggaaactaagtcactaaaaggttaagtgatttgctgaagttcacccagcagctggacttaaccatatcctgggctacctctaagtggatccaagaccttgtatattctagccaactcctaactccagcctctcaagctgagatcccctgaatataccacgctttgcacatgctggtagcacctcccaacctcctattgtttgctgggttgtttactcatcagtcaagacccagctccatttcctcctttgctatgaagtcttctttggccaaaccaagccaccgttgactcaaccttcctttgtgccacatttcccacgtacaggtctcttttagaacacttgtcccctctattgtggttacttgtttatacatcagtgcctcccctctaacctgtgatgaacccctcaaggctgtgtattttttgtctggtggcccagcacctaatacagagcctggagcagaatgggtgctcacttcatttctgaacaaatactgaattgaacattcagcagtgaatctctgcagtgtgtctacctttctctcctttctgttacctgaactgccatcctaatcacaccttcattatctttaacctgaagtactcttatagcatcctgattggttctctgtcttctgttagcagtccaccctccacactgctgcaaactcaattttcgtaattcagaaaaacttcactgctctaaaaatcttcacatgcggtcgggcagagtggctcatgcctgtaatcccagcactatgggaggccaaggcgggagggaggatcacctgaagttaggagttgggagaccagcttggccaacatagtgaaaccctgtttctactaaaaatacgaaattagccaggcgtgatggcgcgcgcctgtaatcacagctactcgggcagctgaggcacaagaatcgcttgaacctgggaggcagaggttgcagtgagccgaaatcatgccactgcactccaggctgggtgacagagcgagactccatctcaaaaaaaaaaaaaaaaaagcttcatatgcatcatcacatcacaatgatgatgatgatggcaatggtgacgctgaagatgatgatggctcctattaagttttagttttcaaaatacttccccatgcattttgtcacttatgcccaatctttaacgcaacaattgccatctccatagtacagcaaggaagttaaagctcaaaaagattaactgattagtccaaggtcactcagtttctaggtttggccagataactctttactcccagtccagtatttgttttccaatctattgaatttaccctcagaatcctcaccctagtactcaagaccttctacaataaggtcccagtcttcagcttcatgcctttttattgctctacaaatactctacctacaagaaaaactagcctctgcttttacttacaccatccccttagtgtgtgaatacccttcctcatatgtctctgagtctctttttatccattaaggctcatctcaaacatcatttgtgtcttgaggcttttgcagatttcccttctatgccaatataataggatagttctctgctcatgctcctccaaagcacttatttctttttctcttacattctgttttgtgttatagttttatgaatatgtacttcaatctacacccaaccatttatctctctttgaatgctctttctccaatgtgaaataaaagcaatacttaggaatcctaataatctcttttaagagcattcagttttactaggcataatccccaaataggaattctaataatccctttcaagagcatttggatttactaaacataatcgcctaaagaagtaatataaatttcctctgagagggatatttacttatctttgtggagactggaacatcttacatagtaagtgctctatataaacttgttgaattgaactgaacatccacatttcaatgcaaacttgcttgctaattttgctttaattatagctaagtatttccgtgtgatttttccatctaacaaattctactaactacatgaaggaatagtaaagaaaatatggttacttaaagcattcaggtctgtaagaatttccaaaacctaagaattatttctatgattttaatacatttataatgtaatgcaaatacaaaatatgtaatatacatacaaaatgtaatttatgaggtacaatgcttttataagattgattatccattacattaaaatttcacactagaattgcatgggaaaatcaagggcgaatggactatcctgatttcctcttctatcacttgctagcctcctgagcttaggtaagtcacatgctcagtaaactaccgtgatttcaagctgtggactttacgatcaatcagatctcagtttgtggtaccttacaaccagaggaaatggggatataactatcccatggtttagtcataaagattaaatgagatcatacatacatacatatataaagaaactagtatagttcccctcccatttaagcattcaataaaagacagtactgattaatatcaagctgagtttctgaattgtctctaaaatgagaaatataacttcactctgagctttagttgttgggagtctgagatgagagaatatatggggaagagttttttaaataaaagaataagtatcatgcaaatgtagcctgtaattaagctaggattattaatgcaaactatgtattactaaaacagaaagatatttaaagagattattattattcctaagtatgatctgtactttttattggagaaaatgtccctaagttttttcatagaaacagatttctgacaaaataatagtcagtgggataatacgatttgataaaaatgtatttcatttgcacctcatttctggtaatgatttaaaatataagcaaaggtaaaatttatcattcctgctaaaattgcacttagcttgctccacattattttatcactgagaaacaatgctatttcattacaaggacactgatcccacgtcactgtagccatggtcctcacccctgcctgtgttccccacttcacccccaaccaccctttcattgctgctttgcctctattgacctactttggccatcctttaaccacttcccagaccatatgtaagacaggaagagaaatgtaatgtttaaagccacttactccaaagtctagctggcgaccttcggatcttataaactcccctgccctttctttgctttgtctgccttctctcctttttcattttcttgtcactcaggaataagcctgtaccctattcccctactcttgagaggtcctcagttttgcccttggggtttcttagtcacctgcccttttttttcctttttttttttgagataaagtctcactaagttgcccgggctggcctcaaactccggggctcatatgatcctcctgctttggcctcccgagtagctggaacacaggtgcaggctgccatgtcccactccttagccttttagatactccaggtgatggaactgagaatccacgtatctgcctcaacacagcatcgccagtcccttctccctacacagatgtctagttactcaagggatacgttcaggtgacttcttttttttttttttgtataggcttataatgccaagactctttatattaaatatactcacttttctcctaaaatgaaagaatagatggttaaatgataaggacacagaatattgctcttcataactggctaacgttttctctatcctccatatcccaattttcaggaggtcatgggcacatgggccagtttccattttcacgtctactctacagcaagactgacgccagtctccaagaacccacacactgatggtgcatagactttcatgtgctccatctgcacaatgccctccatgtagctgaccactcttctgatgccagctgcctctgcctgttttaggacaagtgacaggaggccttgggcatccccacctcacgtagcagctctttgttaccaaaggagagaagaaacaaaaatagaattttagcctcaagttaaatcttcgagttcagagtgtgcagctatgaagacctgcaaagtctgtttagcttacaataggttcaactagaaaaaatttaagccatgttttcatttccctattaaaacaagtgaggagaaaaacacttttcctggtctctctcccttgtctgtcactgccacaggagagttccatctcgaacacttactatgtcacctttgttccaaagtttccagtgaccccggtccaattgttcaagatgctctgtcacatggcaccatcaaggaccactgtggcattaccgcctgctgcttttctatacactgtcttccccaagcctgatgtcttacttcttgtcctgccccaggctttcctgcccccatcttgtttctcttttcctttcacgttattccatctcacttacctctgcattctttctcatcctggcctgtctgtgaaggtgacctgtgctaccctgagcgagccctctctaccctccacttatatataatcaatgccactttttttttttttttttcagatggagtctcgctctgtcacccaggctagaatgcaatggcgtgatctcagctcactgcaacctctgcctcccctgttcaagcgattctcccgcctcagcctcctgagtcctgggactacaggcacatgctaccatgcccagctaatttttgtattttttagtagagacggggtttcaccatgttggccaggctggtctcaaactcctgacctcaggcgatccacctgccttggcctcccaaagtgctgggattacaggtatcagccaccgtgcccggccaatgccacttatttagcaactacatgctactcagtgctgtgagctttcttgtcatgtgttaccactatcagaatatttttaaaatccctactagattacaaactcttcgagggaagggatcatgtctaataatgctcttgtaactcctcaaaggcctagcacaatggtcagaataataggaattaattgaacttctctgtaagtctcttttcttgcctgtgaaataatggtagcaagaaattacactggtttcaccaagcgtatgtgactgttgccaggattgaaggatctgcctggcagatgaccgcagttaactccagaattctttgtgctcagaaacttactgttttctaaacaagacacgggatgaattctgcgacttgggaataaaaatgcaagatgctcacgttgatgtttatgtgtggcagtggctgctgatcacagtgtgatttcattttcagtttctgtatcagaataatcattcagcttttcagttcttctcacacgtattattcgtgttatgacactcttatcagataagtgctgccaacaacagacatggtgatttttacaacactgcatctcatctaaatgctggcagctaatgccactgtacctggtgaagaggaaaacacccctacgggcctgtacctgggacaccaggcagtagccctggagtaagatcaagtgggagacacatattcctcccctaatgggactgcagtgtgcattctgcctgtcaatccattcctagcatttgtgggcaaagacccaacatccccctttaaacacagattccagggtcaggctggaaggctcagaactaggaagtcacacttaaaacctttaagttggcctctaaatcaacaaaaattcacaaacaaccttattttaccactctacagtaaaaaacaaacaaacctgtatagtttgaaaaataataaatataatgcattcatatcgattaatattaacaggccaggaacagtagctcacgcctgtaatcccagcactttgggatgctgaggtgggaggatctcttgagcctaggaattctaggtttccgtgaactatgattgcaccactgcactccagccggggtgacagagggagaccctgtctttaatcacaacaacaacaacaataattagcattttgatggaaatactactgattgaaaacttttaggaaaatggtagctgctgaaaaaagtgcctttaaaaaatatctatttctcatagtatagcataggctgctaaaatgccagaaaccaaaattgcaactgattcaaacacagatacaaaccagcaaataaccaaaaagactgcaaaaaagagggttaacaaaaatcgtagcaaaatcttgtttcttcaatctgaaaacccaggaatatgtccagtttgaactgaaacaggcctgagaaggggattcctgggagctgtacacgtgttttctggtcttataccgacccactggatgacaggatctcagaatgggacgctgattaatctacttcattgcagtgcctgagcttctgaactctgcccctgcctgcgatgaggttaatcatcaaaggataaaatgggggtaacaatcaatagaatcagtttgagaggcagctttcagttcaggttttgcagactgacaagtacgaaagtagccattcaaactggaaacactgagggtaactcagacctgtgcatcccacttgctccttggtctgtagattctcacttatctaaaagcagaggccacagggcatctggcctttcattacttcctttgcatcatcaaaagcactccttattgcagggaagtcaattccatgccactggagaccctacctttcacctccttgacttcagcttccctggaaactgaactctccacagagaggattagaacattgagaaaagtcaagatacagtcttcaccttaaaagtttgtttcatgctagatcccttaattttggacctttctggagaattcttgttctcgttttgcatttttccagctttcttttggggcagaggatgagagtcacctgtcttattatctctctgtgtcaagtacattcctgttctatttatttacttgaaacttttttgaacaataaaaatgaaacattaaaaaaatttattcttcgatccacctggttttcaatgttcattttattacttgtgtttaaaaaataatatgattctcattctttaacttgcagattgttcttagaactgagcattgcattaaaatattcaaagtagtaacatttagattgggtcttcagaattttaggaagatggttttgctgctgagtatacagctgcatggactgagtgactcttgttaaacccaggtgactccaacttcaccacggagtccctgctgcaatatacagacacctgctagtttctggcactccttcaaatctcgtgctcatgatgagaagcaataattggcctgattttaaattttaaaaatgctttttttgacaagcaaaaaaaaaattaaaacatttgaggggcactgagagaatttcccaaattctgaatctggggctgacacatcactgcgtcatttctgagccaaatcttgtcaaatcgtgttaactcgaggtttataaaaagtgagccaaatttctgatcagctcaggagaaaatgcacgttactaactatgccactgacactttatttctgactcacataatactttttagtggtagcacaaacacccagaagtgagccttcctaacagacaaatagatgatcgttgaactaactgtggcttgcaacaatcaaaccactctttcatatatacttaaaggaaaaaatggcattatttgggacagactggaagactgtggaggctggaaggagaagggggtgaaaattacattcttggccacgttttccacacaacccattcctgaacccctttccacagacaatttggaaatgtgcattcaataaaacccctgtcgcaattgcagagaagcagagggtagaagagatcgggcttggagtcagcatctgggaaaccttgtataattttggccttgccataaaccagcagaatgacctcgggcaagtttacttttccgattattagtgtccttatctgtaaattggtatcaatcattctatcttgcaggattacctgagtggttagtgataaatatacaaagaacctagcgtaatagctggcacatagtaggtgctcataaaaaataattattgctgtattgctacctttataactagtgttgacagcttctggattcgacctggtgaggaaaggggataaatatagaagacgtttatgaatttgttttttaatctattttactctttaattatttaatatttaactggttaattattcatagtcaaacagaaggcttaataaaaatgtgcttattaaacaataatttgcttccttaactcccttcaccactaaagcagcatgtccataaagggaaggaagaatgctatctcagggtctggaatttttcttcaaagggatagttactagaaatcagcatacatcctctttctagtttggggctctacagattagaagctttgccctcatgctatagactacccttgcaggcaccagcttgggtagtataggaggtgttaggcaagctgggagtgtagcgggaggctacctggctatgatgacagggcagtgattactgtccaggcaggtggctgagcaaggtgacaagcctgggcaagaataaaccctggaaactactggggccaggatcaaagttcccggtcaggtgggacttctggtttaccagagggaaggttaggacaatcctgccgaaggcacatgcctttctccctttcaaatgtttcccagctaaaccacttccaaatgagcaggcttctactaactttatgcaagtatttttctcagttttgagaggtgatttataaatcactgaatggcattgccctaggacagcagggatgtctctgggtcttaaggatgaatgtgaaggcaggatgactttataggaaacagaaaatgtctactaacatgctccagatattgacagtaaaatccagaggctggaggaaagctggttagccttggaaaaaccatcttttctttttcttttctttctcctttttcagaaataaggttaaactatccttaagaataagaaggaaaatattaaaacattcccccccaaaagttcatagatcttcaagaaaagagaagttaggaccaaaatataaacaggatgacaactgcttttatttgaagaaaatagagttttctagaagactgaatcagtatagcctgataaagtgcttatccattgggaaaagatattctatgggagcaaacaaataaagataaaagaggaagacattaaattaataatggctaaagaaggtgagagcctgaactcacttgctaaatgtgtctttaaagagggagccaacatgatctcacaagagtctctatgagaaggtgagaaggaaggttcttagtactcaagggcgaataggcaatctacaaatttcagaccaatgtttttatcccttgatgttcactgacaacacagacacagttccctgttttgaaaagaggtctaacaatcatgctgaacagtctgagacttaatagagccaatcagttcagtttctattagtgcacctgtacactcaggcatgcgttcaaccaaacacacatttagacactcagactactctaggtcttgggaaacaaagcagaatacaacagacatggcccctgctctcaggaggtgtaagcaccatgagaggagagaagcaataaacaatgaacaaatacatgtaaacgcaacagatctatattcgaacagttgctgcatggttctgatgggtctaattagcattttggcaaagaagaagcatgagaagggcatggattctgtgtcagacatttgaggggctggcttgtggaaatgacattatgtgtggtttaaagctacagggaagattttggttttaataaacttcctaacaatttctgtcactaaacattccacaggtgttttgtgctaagcactgttccaggtggctacattctggtaaaatgaggtagacagtaaacatgtatatgacactatgtaacatcacacgttgtaacccaaagcagcataatttggcataatgtaatataacatagtaaccattaaagctgtgcatcagtaaactggccatcaccatcagtgaaatggtgagctgcagctgggtgcggtggctcacgcctgtcatctcagcactttgggaggccgaggcgggcggatcacgaggtcaggagattgagaccacggtgaaaccccatctctactaaaaatacaaaaaattagctgggtgcggtggcaggcacctgtagtcccagctactcaggaggctgaggcaggagaatagcatgaacccgggaggcggagcttgcagtgagctgagattgcgccattgcactcctcgaggcatttgggatcacaagcagagtgggatgtctctgggaatccccagcctggagcagcttcctctgactttggtggagccacatgcagggctcagggcaacttctgctctctattcttaaccttccttaattgttgtgtctcaatattttcagtctcaattcctgactcaatgaagttcttaatttcatatgtgatccctggtgggtttgggacacatgatttcattttagtttttaattgaaaaagtatttattgaaaaagtatttccataatattttctgcttaaataacatatgcttctggttaaaaagttaaacattgcaaaaaaaatagcaaatgcaggagagtgaaaccccccaggatcctaacacctgcagataatgtcaatggtgaccagtgttaagcactgggtacttatctgatttttatatacatgcactaagatggggattatattaatatatgtatatttaatgaggtcatactgtttggtgatatactctttttcactgagcatctttcccaacacaacatacaaatgggtcttcttttttgcagttattattttggattggttcatcttaaaagtctttctacctaagaatagtttacacaccatagttacagtgttgcaatattctgtttttctgtgtacttactgttaccagtgagttttatgccttcagttgatttctggctcattaatgtctttttctttcagattaaatatctcccttcagcatttcttatacgacaggtctggtgttgaggaaattcctcagcttttgtttgtcttagaaagttttaatttcttcttcctgtttgaaggatattttcaccagatacactattctggggtaaaagttttttttcctttagcactttaaatatgtcacgccactctctcctggcctgcaaggtttccgctgaaaagtctgcggccagatgtactggagcaccatagtatgttacttgtttcttttctcttgttgcttttaggattttgtatctatccttgacctttgggagtttgattattaaatttcttgaggtagccttctttgggttaaatctccttggtggtctctaaccttcttgtccttggatattgatacctttctctaggttccgttattatacctttgaatacactttctccctatctatttctctctctgcctcctctttaaggccaacaattcttagacttgccctttagaggctattttctacatcttatacctgtgcctcactgttttttattctttttttcttttgtctttgccgatcatacattttcaaacagcctgtcttcaagctcactaattcattctcctgcttgatctgtttggctattaagagactctgatgcattcttcagtatgtcagctgcatttttcaactccagaatttctgcttgattctgtttaattatttcaatctctttgttaaatttatctgatagaattctgaattccttttctgtgttaccttgaatttctttgagtttcctcagaacagccattttgaattctctgtcacatacctctgtttctccagaattagtccctgacaccttatgccttatctagttcatttggtgaggctgttttcctggatgatgttgatgcttgcagatgtcaccggtgtttgggcactgaataattaggtccttattgtagtctttgcagtctgggcttgtttgtagctgtccttcttgggaaggctttccaggtatttgaaatgacttgggtgttgtgactgacactgtatctgcattagggggcaccccaagtccagtaacattgtagttcatgcagactcacagaagtactgccttggtggtctcggataagatcaggaagaattctctggaataccagacagaaactcttgttctcttcccttactttctcccaaacaaatggagtctctctttctccctgtgctgagcagcctggggctgggggtggggtgacataagcacccctgtggctaccacgactgggactgtgctgggtcacacctgaagccagcacaacactaagtcttacccaaggccactccctggctacagcctgtatttgctcaaggccctagggctctatgatcggcagacggtgaagccagctgggtttgtgtctttcccttcagggcagcgagttcccccagctgggtccagagatgctgtctaggagccagggactgaagataaaaaccttagaaatctacgtggccttctattccactctggctgagctggcactccaactgtaagccacagtccttcccatggtcccctctcctttccacaggcagaagagcctcatcccaaggccacgaccacgacaggcccacagggattactgccaggccactgccgatgttaacttaatgcccaaaggcccctcagtcaagtcgtggtgagtgctgcctggcctgggactcacccttcagggcagtagactcccctctggcccagggaaggcccagagatggtatccaacagccaaggcctggaatcagggacaccaagagcctgcttagtgctctaccctgctgtggccaagctggtacctaaggtgcaagaccaagtcccttttacttttccttctgcttttctaagcagaaggagtctctcactatagccaccacagttgggaatgtggtgggtctcacctgcagccagcagtctcagagtctcaccaaggcccatggcatatgacctgggtatcactgctggttattcagggaccaagggctctttaagtcagcaagagatggatcttgccaggacttggtccttcccttcaaggcagtgtctccttctggcccagggtgtctctctagaaatgttttctgagaggtacggcctgaaaatggggcctcacagctctgactggtaccctatccctctgtggctgagctgataaccaagatgcaagacaaagtcctctttactcttgcccctcctgtccttaagcagaaggaaggggtctcttttgaagctgggagctttgttgcctgggtttggaggaggggtagtgtaagcactccctattcacaatagcaaagacatgagatcaacccaaaggaccatcagtggtagactggataaagaaaatgtgtacatatataccacagaatactacgcaaccataaaaaggaacaagatcacgtcctttgcaggagcatggatggaactggaagctgttctcctcagcaaactaatgcaggaacagaaaaccaaacactgcatgttttcacttataagtgggagttgaacaatgagaacacatggacacatggatggtggggaaaaacacatactgaggcctgccatgggggatcatcaggaagaacagctaatggatactgggcttaatatctgggtgatgagttgatctgtgcagcaaaccaccgaggtacacgttacctatgtaataagcctgcatatcctgcatatgtatcccagaacttaaaaaatgaagaagaaaaaaaaaaaaaaaccagagcaattcacactcaacagcatgccagggaagatgtctcagccctggtgtcctgacaagagcagtttctgaataggaagaaggctggcacaaatggatacagcaacacattctagagatgcaaagttccaacaaaagcattttaaaggtcaccttgtttatataatatttatgttttaagaccttatgattcccccaatatttcaaagctctcagagacaaaagaataacatggtataaagaagtggaactcggaatgaggagacgtggactctggtttcagagccacaggaaactgtggaatctggaggtgaagacaaccccaggaagtgacgtatttctaaattttctgatgaggacacccggccccaagaagttctgtgagctgcccaaggcctctcagtcacttgtgatacagccagaatgcagggcaggggccactgtgtccttctatgttccttcagtctgcaaaacagcgataagaatagctaattggggttttctgagaagttactgtattggaaaccataaatatgtcatttaatgaagaacaatgagcttcggcaggatttcttaagtgtgaatgcaatcgacatgcggtattcctgccttcttggttctctcgtctcatactcaactctggtcccctttcccatcctccacctcagaaaacaagaagtgggacaaaataggaaaggagagaagaggaagaataaacaagaagtgggacaaaatagggaaggagagaagaggaagaaaagagtgacgatgagccccgggcgaggtggcaggggcctgagaggcagggaaggcaaatggggagctttgttctgaccaggccgtgtgcttggtctgtggggcctctggcttcccatgggtgagtcctgtgagaagaactgtgatagtctaagtgtctgccaaaagaagggagtgaattagatgcaacccattccaccctgcctcaggaacaatgtacacacaaatacatgtcaggattctctctgaactttacacagaaattgcctggctatgttcagctcttctcagggagagaaacagaaagtatttgctctggaaatcttgtatcaatatataaccaagatcttaatgttttcagacttgccccttcctttttctagcatttgttttttcttctgtatctcctcaggaagatatggtggcaattaaaagaaaaattattctgaacagcctgaagtgatatggctaagcctagcaccacttttatttcagagttaaacaaccatgacttaattctcaaattgcttcccaaccctgggaagttaaggtcctagtctccggctaattctagaaccatctatcattaaatgaagttgaacacaaagaaggggcgactgcagctaagggaaaggccgtcaatcctgacaccagattaatcttccccaaatgcctttcctgcctgagagggtttgtggctgcttgttagactagatccaagttctcagccttgtctcaggcctgcctggccattgagtgtctcacatgcttcccaccattcctcatgggagcctgggttcagaccggccaggttcccactcccgttcacaggaaggaggctctgcgactttcacctgcaggctctgctcacccgttgtcacttccccatccacatcctacccttctatcacatcttccttcaagaagactcacactgttcaggaaacacctgctcactgcctccttaagttcctttctctaaatgtctacagtgttaatagtttatagcactcagcccactgattgagaccacagctaagtttctgagggcagagaccccctctgtttagttcactgctccttccccagtgtcaagcttagccaggtgctcattaaagaattacaaaatgagcaaatggttacttgactcgtgaggtaggataagacaatgagactgattcttaaactacttgctgtaatataaactcatataattttttttgttgctacaaagctgtcatctaggcaggtgagtcttttattactaaaatgcttggagtgctcaaacgttttgggaattcttctttggaaactgtgctacgtcaattcctggggttggggttgaggtggtgggggtggaggttggtgtgatgggggtggggaatctcagagttaagactggatatgaattaacaaagagacaaaagtcactcagggccaagccttaactgaagtggctgattaagctagtgagagcagttctggatcaaaactgatcaaaagtcagtcctattcaacatagtattggaagttctggccagggcaatcaggcaagagaaagaattaaagggtattcaaataggaaaagaggaagtcaaattatctttgtttgcagatgacatgatcctatatctagaaaaccccatcgtctcagcccaaaagcttcttaagctgataagcaatttcagcaaagtctcagcatataaaatcaatgtgcagaaatcacaaggattcctatacaccaacaacaggcaagctgagaaccaaatcatgaaagaattcccattcccattcacaactgccacaaagagaataaaatacctaggaatatagctaacaggggaagtgaaggacctcttcaagaagaactacaaaccactgttcaaagaaatcagagatgacacaaacaaatggaaaaacattccatgctcatgcacaggaagaatcgatatcatgaaaatggccacactgcccaaagcaatttatagattcaatgctattcccattaaactaccattgacattcttcacagaattagaaaaaactattttaaaattcatatggaaccaaaaaagagcccaaatagccaaggcaatcctaatcctaagcaaaaagaataaagctggaggcatcacactgcccaactttaaactataatacaagactacagtaaccaaaacagcatggtactggtacaagaacagacatacagaccaatggaacagaatagagaacccagaaataagaccacacacccacaatcatctgatctttgacaaacctgacaaaaacaagcaacggagaaaggattccctatttaataaattgtgctgagagaactgactagcgatatgcagaaaactgaaactggaccccttccttacaccatatacaaaaaatcaactcaagatggattaaagacttaaatgcaaaacccaaaactaaaaaagctctagaaaaaaacctaagcaataccattcaggacataggcatgagcaaaaatttcatgacaaagatgccaaaagcaattgcaacaaaagcaaaaattgacaaacgggatctaattaaactaaaaagcttctgtacagcaaaagaaactaccaacagagtaaacagacaacctacagaatgggagaaaatttttgcaatctatgcctctgacaaaggtttaacatccagcatctataaagaacttaaacaaatttacaagaaaaaaaataaaccgctccatgaaaaagtaggcaaaggacatgaacagacacttctcaaaagacatacatgcagccaacaaacacatgaaaaaagctcaacatcattgatcattagagaaatgcaaatcaaaaccacaatgagatatcatctcacgtcagtcagaatggctattattaaaaaatcaaaaaacaacatgctggcaatgtcgtggagaagaaggaatgcttttatactgttggtgggagtgtaaattcaaccatcgtggaagacagtgtggcaattcctcaaagacctagaagcagaaacaccatttgacccagcaatcccattactgggtattacccaaaggaatagaaattgttctattgtagtgctattagcaatagaaaagacatgggatcaacctaaatgcccatcaatgatagactgaataaagaaaatgtggtacatatacaccatggaatactatgcagccatacaaaagaatgagatcatgtcctttgtagggacctggatggagctggaggcctttatccttagcaaactaacacaggaacagaaaaccaaatactgcatgttctcacttataagtgggagctaaatgatgagaacacatggacacatgtgtgggaaagacacacagtggggcctgtcagagggcaggaggaggtaggaggagggaaaaatcagggtgatgggctgataggtgcagcaaaccaccatggcacacatttaactatgtagcaaactcgcacatcctgcacatataccccagaacttaaaataaaagttggaaaaaaaaaaacccaagtcaggatgccattcctcatggctcatcctcgctctcaagaagaaagccattataggaattcctgaaagacgacaacatcattagaatgagtatttagattctcaagatgactatttcaaaggacagtagttccttgcatgcactaaaaataccccgaaacatgaatacttcttttttaaaatgaatctagcaactagcacacagaaggaaacaagtcaatacccactgacctagttgtggtagaacactagtttagttctgggcaaatataaactttaaaataaacccgatgctttaaaaataccaagcttctacagtagaacgataaaataatacaacagtaggagacatgtgaaaatgcatgactatctctcaggaggaaacaaagtgtggggaacttttaaaatacaactctcaaaggggtttcaaatggcatcgggggaaaaaaggaatgcacttgatgttcctggagttccttataattgtgtctctttggctcctaacaaagaaccagcagcagagtcaaaattattttgggcaaatttcaagaaattaaaacaaaggtttaaaaaatcacagaagagtaggggtcagtttgtttacctagcacagacagatggttgtatttctgtagttagaggagcaatgcagaaagacttccaaagttccagatgaggcacatttgccaagaaaatgcttcaggttggcagaaggtagaaaccctgtattggctaaatatttagcaacactgaagaatttttaacactaatatctcatttggagtggaatatgctttatggtctgaattctttccccactctgttttataagtgatgataaaaatcaaaacataatcacctgtcgaggatgaatcctgcacctgtgaaattatatttcaaacaagccaacttcctaattacaatggagagggaactggcatgaggaagcaagttatttccaccattccggcagtgggctccaggctcccagatgaagagctgttggtacaaccacaaaaaaactgctaaaatcatcttttattattcctgtctgcacaacaaatagctccatctggggctcaatggtagactccagccaaaatttgtaagggctcggctctgaggcatctgatagcagccctgcataaggcagaaaatcagaccaccatcagcaccaggatcactgtctacatgagttgatgaagagtttgtggggggcactgggccgagcatgtcaaggggcacagaaaattggaagcatggaccctgctttaaagaagcttacagggcagttggggagataggaatctacaaacacacatatgctaaagcacaacagtccctcagttatgtgtggcaaattccaaatgagggacaggcggtgatgcttggaattgagcaaagtcagagcccgctgtgagtggcagtagccagtgccacacaaagcaggcagggtgtgagcatcttctgagaacttcctacatgtaagtctccacgctgagttcctacccaggtcctctcatttacctgattccttcccaggagcatcctgggagagtgccactaggagaccacagttcttcctgcacagaggaaaccttccatttctccacaacgtttgcttgatcctacttgactccaggcccttcctgctgggctttaagccagttgataccacagtggctggcgcaactctgaagtgtgcatgttcagagtcctgagtccctagaccctgggcatctgcagactgaatgctgctgcatcccagggctcagatgctgagtcatggggagtggtctttgggcttttctcaaaggagtacaccgcactggatatttatgtccttagttgggttgggttaagcattcccatctgcgtgccctggtaagcttctccaatagatgttatgtacaaggctcttcattcataactctttcaaatatctcaggtaaggattgctagctcttcgcctccaacatctggcaggctttctacctggttcctttgctttctgcctctatgaaaatgctctgaagtgctggtcttggccaggcaagctacctgtaggccatgtcttcatgcacacagacaagttggctgccttctaccagctcccggtggtcccacagagcagatgcgccacaggctgtgtcctgtacaccctggccctgggagcgcaggctcagtttgcacagcattactgaagcagaccctggggtacttaaaaaaagcaaaagcaaaaaaaaaaaaaaaaaaaaaaaacaaaatgcaaaaattagttccagcactatcagttcaaatgggcaatgtgcatgtccatatggctgggctcctccaggtctgactgtgcaataaagacaggtttcagttggtttgttccaggcctgagagccagaaggcagagcagtctctgaagcactgaagccagagtgacccctgcacatcgcatcccttctggatcctgcctggagctctgtctgcccggaacacccttctcctcctccttcctctggtctcctcctccttctccttctcatctcttatctccttcaggtctgtggctttccccagcagtttacacagtacctggcactaggtgaagctcaaaaatatttgttcaaaacatgaagtaatgtacaattgatacaaggaagggatgacacaaggtgcctcagacaggcagaaacagaggggattaacagcacgcatagaaagcaatagatgtattcatgcataagcacaccagcaggatgccacccaactcccaccataactggctgggacaatgcttggtagcctgtctctccccactcccatctctagatgctctttcatgtgaatatcaatgtgatctatgtcatcggtctgccaatctatcttaacaatattaagtcttcctatccatgagcacagaacatttttctacttttttaagttttaatttctttcaacaatgttttatagtgttcagtgtacaagtattgcactttcttggttaactttattgctaagtgttttattctttggatgctattgtaaatgaaatttccttaatttcatttttttgattgctcattgctagtgtatagacacaaaactgatttttgtatattgatcttatattctgcaactttgccaaacttgtttattacctataattttgtgtgtgtgtgtgtgtgtgtgtgcgcgtgtgtgtgtgtgtgtgtgtgtgtgtgtgtgtgtggcggggttggctctttagggttttctatatggaagataatgttatctgtgaattagagatagttttacttcttcctaatttggatgccttttcttttcttgcctaattgctctggctagtacttctaggataatactgactggaagtagtgagcagacacccttgtctagctcccgatcttagggggaaagcatctgctcttttatcattaagcatgatgttagctgtgggttttccatgggtatctgttctagctggaggagggctgcctctgttcctggtttgttgggtgtttttatcatggatggttgttgggattttgtcaaatgctttttctgtatctattgagatggccatgtggctgttatcatttatttatagttagagtatgttatattaatttcaatatataaaatcaactttgaattcttggcataaatccctaagaaataaattcttaaaacaacagcaagatgataaatatgctcataatattacatagcagtgtggtgtttcacatttttcagggaattttcacaaacaaaaaaccctgggtaagtgaccacacagtcacagttattattcttattagtcagttacgtatttttgtgtatttagagggtacaagtccaggtttcttacatgcatatactgcgtagtggtgaagtctgggcatttagtgaccccatcacccgaagcgtaaacactgtacccagtagatagtttttcagccttcactcccctcccacctttcacggtctattattccactttgtatgtccatgtgtacccattgattagcttccacttgtaaatgagaacatgtggtatttgattttctgtttctgagcacacagttattattattagtcttcattttacaaggaaagaaacaaaagctcagaaacttctccaaggatacaacattggcaaatggcagagccacgacctggattcaggtcttctcatttgtggtctaaatagtcacatgcacggagagagtgttacagttatactgaaaagatagccgcacatcattataagaaaagataaagaacacatctcattcaaaactagaatcccagcatctgaaggactactgaagtgtctaatgagcatgtgttcataatccttttctatgggttgttctgatcactgtaggaggagcaggacttatctcccatctccaaacactctcccttgacctcacagcagactagagcaactatcccatttctctgctcctctttatagcaaaactctccatctaaactccctgtcctgattccagtctgtgcttcaagctgacgctggtctggcattcctggggctgattctcagtttcccgcctactgaacctctcagcgctctgtctgagtaaataattctctcctagatggatcactttcctcctggccatcaaaacatctactcttagcttctccttcccaggttcctttgtaagatccttctcaccttcctgatttttatatgactgtgcaacccagggtttggctctacaatcacttcccttttccagatatacttatgttctggatgatctcatcctggccacgtttaccctgccaaactacacctttcgcctgaatgccaaacttgtgcatctaactgcttcccagctacctccactctgatatctgaatagaaccctaagtgtacacatttaaaactcaactctcgagttccaccacaaacctgctttttccattgtcttccccatcttagtgaatggcaacttcattcttccatttgttcagatccaaaccctggactcatcttgacttctctctttctttcaccctgagcatgccatatattactgaatcctgatagcccaaccctcaaaatgtatcctggatctagtcacctgcgacctccaaggctgcccaccttagtatacaacactgtcatctctcatttgacttttcctgaggtctcttgcttccacccttgttccctgacaagcctcttctccctatagcagccagagggatcatttaaaacacaaaacagatcatgtcagtcttctgctgaaaaacttccagtggcttcttatcttatggagaatgaaacccaaggttcttggatctggccctggttccctccatgactcagtactcatcattctccccttacttactctactttagttacaatgattttctccaaacaaaccaaacaggttcctgcctcaggacctttgcacctactgttcccttggcctgtccacccttctccatgtcagcaatgccactccctcccttacttgatagatctctgctcaaccacgacttcagcagagagggcttccccgtctgccctatcttaaataacaccagcccagtcattctctattccctcaccttgccttatttttcttcttagcacttatcactgcctaccatttatatatttattggtttatctgtttattatctccccttgctaacatgtaaacatcatgagaataggaaaccttctctgtttgttcattgctatatcttagggctgggtcagcaaaacaatggctgccaggccaaactggcctgccacattattttaaacgatgttttactggaacacagccacaccacttcactcactgctgttatccatgggtgcttctgtgctacagaagcataattgagttgtcacatcagagactggatggccctcaaagcctaaaatgttgaccatttggtcctttccagaaaacgtttgctggctcgttttggggtctagaagacaatgctggcacacagtagaggcaccaaacacatttgctcgatgaataaatgaatgaatgaatgaaataaaagaagaaaccaagaagcggattaagaaatattataccaaaagggcatttgcatttgttaccagattaaccaagtatagcaaaatattagaaagagtgatttaaacttaacagaaatccaaataaagaaaaaaaaaatcttataattctgttttctataaattaagaattatatgaggtgagggaaatgctggggtgaatactgctagcctgtgtgacattcaagcttatacagaactttattatctgggggacttcagttcaaataaatgaacccacacacactaaaaacgatcgcttcagaaacctgaaagggttttttctttttcttctttacagatcttctttacattcaggccaatgttttgattttccatttccccttgggcatgaagacagttttcttttggagttggggtccccacattgtaataactgttaacagagtgcacctgaaaggcttaaaggtagaccctaccaaaagccctttggcccaaacatctgtaaatgctagtgaacattatcagataaagaagcaggattccctttttatgtttttaaggtaccaattctgccagcatgagagagagtagaaggaacagaactcaaaaagtacaaggtcagagttaaaattttaaaagatggtacaaagtccccagtgaacagttgcaggacacactgcctgagctgtgctgccgccataggaagaggggcctgccatagtcctgcaaagcttttccgcggcaatccatctgaaactgctcctgaaactttgtcaactttgacctgcaacactggttctcaagaaagccagtcaacaagcatttgctcaagtccttctatgctttactttgagtttaacatcaaaggctcaggcctctcttctgatatttgaccactttgactggtaattaggtttgtggatgaacaaacacctccatctcaacacacgtacaaatgcagtgttcatggcaaactcagagacaagacttctgcaggtaacattagtgttctaaaacccacaacaacacacaaagtattttaaactaatggcatttagaaatccagaagcaaaaaagacacaaattcttattttggcacatgagtgtgtagaggatctgttttctcaagcacaaatattttccaaacaaatagttttaaacatccaaaaagtctgtctttccttgctgttttagaaaagttcctagggcttctgagaattttatgagagattaaagacagtcaatggctgcttggtacctggcgcccaggctggacttatcttttcttcgcatatctttggcagaggatagcggtagataaaatccattattgacagaaggaaaacagacaatgagcagagaagtaaatgagaaagcttcattatttacccaactttgaaatggtaataaagcttttgctctatcccaaagtttgacaattgccatgcactgccaacccctacctctcaagtcccctttaatatcctcctccaaacttgaggggttccaactgtggagattctgaaaagctgttgcacaccacctcctcttctagagcctgcctatcccaaggggctgacgcactgtcagtgtctggggacgctgggtagacaatgcaaacgagagggtgtaaatgtaaattctgcatttgggtaccagtggctgtgctgcagtgtgagggaactcatccatctcaggaactctggcctctctcacgagagaagaaagatgccctgtgagagcagaggaatacacggcacaggaggattcacttctgcctcacactgtcctaaggactaagccatgctggccactgacgaaatacgtgttcttttattaaccaaacaacatctttgctcaaatcatctgtagcaaatcatttagcctgactgcttttctggaatccagagctgtctttctaaaatttgtgatgtggaagctgtcatttgcagaaacttccagaaaaagaaagaatggtcaggagaccatactgaaggtatatatccagccacttttctaaaatattttattcttgctgtggtacatgacagggcccccctggaaagggaaagtgattcaagagggtctcctatacctgacttgagcggtaaatcaacaaaccctttcagcacctactatgtgctaaacatagatattgtatttcatcaattatatattgcccgttgcaagtactttttgaagctgcattaactctctttgatcaaaaacttactttttaagcacatccaagtgtttctgaaaagtattcaaagaaaacactaaggtaacctctgcagatgccttgccgagaggccagtctgcattccccttgccagtggctctagcataagtgattagcaggggggttaagacccaaagcccctcagggaatctggatacagcatctgtcaatcagaaccaagcccagatagcccagttaccagaactttgtcctcttggatagtttcccatctagaaacaagatttgggtgagtctccacaagtctgccgttttcagcaccctcgtggatggtctggaggcattctttgggttgttgcggagcatgtgtgtatatttcagtgtagtagtatcctgccaaacctctgcaggctctaaatatgatagagcacggtagtctcgcaaagggaatgtgctgcacagcacagaaaggagatgaaaggtacaaggccttggagttagtccctctagaggcctgaaacaagcccagagcaaagggtgaccggatggcaaataaaagtgcacagctcagtaaattatgcaagttcacattacatgctagtatgatattggaacggcataaagctttgcgcagtattaagacattctgtttctcaactttaaaatcttaggctatcggcatttgagagaagaagctctatcaggcatttcgctgcaagagcaattttattctactgaataatgtggacttactttctcttagccactttttattttaggatatgaagtattaataggtatataccaaatgtaactgtattgtcctatcattcagtccatacctttcaggtgatctctataggctgatcttgaggtgagtacattttaagttattagagtttaaaaactcatgataacctgatcaggaggttgtgttcagcttcctctttgcaaatatgtctttgctaccgtggctggcgtgttccctcactccttaactccagctctgcaattatcctgacttgtttttaaaccattgcatgttgctgagtgtttgcatacagcagcgatgttgcgccctctgaggttttagtcacttatcctcatttatatccctgcttgtgtcccggtagccaggagagaatgcagatgtggaaagagcaggagagtgagttccagttactgcaggtcagcctgaattggcttgtctgttcttaatcgaactctggcaaagccactccaggttctaatctatgtggacctctataacagaaagcaagtgaaatcgagaattacagtcatgcagtccacgacaaatgaaaatctatgttactaccttagtgccacactcacattaaacggccatttccaaatttaaagtaatagcacagaagtggcttctacctgcctttataaggacagcgctagttcgaaaattatatccaaatctccaaaaattacctgtaaaggttacaactaccagagacaggaagattagcttagaaataataaaactttactctctccttattcctcttctctttttacaatgcaatctcatcacaggttctacatgaacaataaaagggggacatttttatttccccttagatttcttttacttaaaagttctaaaaactgttgtagataacaggcttttctgctgtctccttccagtgaatatgtggaagagtttagaactcttcagaaaacttcctacttttcacatacactcaagaaattctgagagtttgaatcagcatgaacctttaagtgatttttttatttttatttttagacagagtcacgccctgtcacccaggctggagtgcaatggcgcaatctcagctcactgcaacctcagcctcccgggttcaagcgattctgctgcctcagcctcccgggtagctgggattacaggcacgtgtcaccatgcctggctaattttttgtatttttagtacagatggggtttcaccatgttggccaggctggtctcgaactcttgacctcaagtgatctgcctgccttgacctcccaaagtgctttaagtgatttaagaagaacttgagttcacttagtgcctgtgccccattgacatagtctctgcctgatgccccatggccattcgttgagtgcggactctcaaatcttgcacaattacgggtgctttctgcaaaaggatggtagggagatgaagggtttgggctttttattctgactgccatttcttctctgtactcttgggaatgttgtttaatccctcaggctcagtttcctcatctgtaaatggggactggagattgataacggtatttgactcatgaggccaatgtgaggctccatgagatattggcactaaagccaccatcagtccgcacacactagctcagtgtacatccgttaatgtcagttgtggctattgcaatgattaaagattaacacggccataaagcgaaaggtagaatattgaatgttcagataaaataaagttcacctttaaaacaacagatgtttaaaaaaatcaagattttccaccttttacttcttgatcttacatggtaataatgcaagtatgacagcgcaatgcagtaagcgtaaggttgataattgtggctctgcccagaaatcaggggtgtgggggccagtaaatagaacagatactgaaaaacatttgtgggttttatgccgtagtgctataaagttgcatagtaaaaaaaaaataaactataacttcaaactaatccttttatgccagcatgctgtaaaatatttagaggattcgggctggctttagtgatggattcaatgtgccgtggagttttgtcctttcccaaactttagctgcaatggctgaattcccaccacaccatctgttcctgacacttggtctcattagtacgagtatttttattgatacacacagtaatgcttctcataccatcttagctaagcattatttattgtatctatatatacaacaatattaacacagtcaagcaccaggatcggtacttgagggcatcattaaaatcagccagtgttcagtgagagacttaatgatggatttaatagtattaaatgggcaaaaatgcccttggcctttacatgctcatttaaaaacatataaaagagcagtaattcaggcagttatacttctctcaaagattttgctctaaatcacagatggcagcgggaggccacggctgtgtgctggctcacaccccactcactccaaccgaagccagaagtgctcgttgggtcataattagcaaaccacccgcaaactcgactctttaaatcagaggccagtgactgccaggctggggcatagacgggagaaaacaagcagaaatggtcaaggtgctctctggagcctgccttcggatagctgtgacccccacgttaggcatcaagacagggttccacacctgcgccgccacccctgcagtgtgagcgctgtattttgctttctgagaaagcctcacggtttggctctttggtgcatgaggctttaaggcgatgtgccccctgcccagctgttgcccagctcccagcccttgccacagacagcatacatctctgttttagaaacaaatcatttagtcacttaatcatgaattcccgatgatgtacgtcctgcagaggtctgagctggggctgctggtctgaaagtctacgtacttctgactggagacttaggctaggctgggtttcaaatttggatgaagacggttttggctgagcagggagaagaaaacaaacaaacgaacaaacaaacaaacaaacaacaatccgggagcctggagtttgctgagaggctcagctttggggagatctggggctggccatccttggagtctgcttccttatcagcaaacgcctcctaaagttgttatgatacttctcagaactagacagcatatatgaaatcagataatgcacagttgtgcactacttggtgacattttggttaatgacagactgcatatatgagggcagtcctgtaagattataatggagctgacgtcctatcacctagtgatgcaatagccattgtaatgtcacagtgtaacacattactcaccattgtggtgatgctggcgtaaataaacctaatgcgatgccagtcatataaaagtatggcacatacaaaattatgtacagtacatactatttcataatgataataaacaatgatgtcacaggtttatgtatttactacattacactatacttttattattttagagtgcactccttctactcattaaaaaaaagttaactgtaaaacagcttcaagcagttcctcatgaggtatccagaagaaggcactgctatcagaggagaggacagctccacgcatgttaccacccctgaagacctcccagtgggacaagatgtggaggtggagggctgtgatgtcgatgatcctgaccctgtgcaggcctacactaatgtgctgtgcctttgattttagcccaaaaaaattaaaaagaaaagcatttttaatgaaaaaagcttacagaataaggatgtaaagaaactatttttgaatagtcgtacagtgttgtttgtgcttaaactaagtgttattacaaaagagtcaaaaattacacaactttaaaaatgtataaagtaaaaaggttacagtaagaataggctaaggttaatttattactgaagaaacagaagttttttaaaaataaatttagtatagtctaagttcacagtgtacagtagtgtacgataatgtcctaggccttcacattcactcagcactcactcactgactcacccagagcaacttccagtcctgtaagctcctttcgtggtaagggtcctatgcaagtatactatttttaaaaaatcttttatgctgtatttttactctaccttttctgtgtttagatacatatatagttatcattgtggcacgattgcctatagcattcagtatagtagcatgctgtgcaggtttctggcctaggagcaacagaccataccatatagcttgagtgtatagtaggctataccatcttagtttgtgaagtgtgatgttcacaaaacaatgaaatggcctaacgacacatttctcagaacatatccatattgttataccatgcatgactgcatatgaaatgcttcatacaaagcttggcattcataattttaataagttgttggccaggtgcggtgccatgcctgtaattccaactctttgggaggccaagttgggaggactgcttgaggccaggagctcgagaccatcctgggcaacacagtgagacctgtctctacaaaaaattatctgggcatggcagtgcatgtagctgggcaaggtggtacatgcctgtagtcaaagctacttgggaggctggggcgggaggattgcttgagttcaagagttcgaggctgcagtgagctaactatgccactgcacttcagactaggtaacagagtgaggccctgtcaccaaaaaaaaaaaaaaaaaaaaaaaagtagttgaggattcaggccactggttctgccttcttttccagacaccctagaaatcatgaaaatggaaccagaatgacagtatggctgccctctcccagaacttccaccaggcctctctgcatcccccctgggattaacctgcatggatggcagcccagcctcttcctgcctctggcctcaggagagactttcattttggaactgctgacaatcacatcaagaacaggtcatgtcaggagaggctgggaatgatattgctcgaggattcggaggctgcttccatgggaagttacagacctaactgagtccttctcacacttcttaaaggctttcaggaaaaataaacatcagtggcataagcgcaagctctgcaaattaaaagatggctacaaaatgatcttctttgcattttaagcaaattacagaatcattcaactaatttcaacaatgaaaggaatgtagatccagtgaaaattacacatgcatggaccctggtgatgatacctaaaattagattgttgatggcagctcctgcaaaaataaatgcaaagtgattgctcatcagaaaatacatactgagttcccatgtgaaactcctgcctgtgataaattcttccaacgaaatgactactcaagcatttaccaacctgccttagaaaatagtgcaagctaatgtttcttgtccaaaaatgtgtatacagcacagataagaaaagaaatgtgacagtaacagcagagtcttgaactggctgaaaagcccatacagtaagtgctataaggacatcaactaggaactgggctaacgtggtaactagtgtctgacagcagcacccacagcaagacaactcaaaatttattaataaaactaccacaggctttcaacatctacatacaatgggcctaaggctttgtaatctttgaatgaaatacactacagagaacctcctagtgaatgaatgaaagatctaagattttcttctctttgcaaaggaaccctgagctgtattcatgcatttgaggataagatgtttcctttatggaggagtttgcttttacaattttattatcaatatccattaagtagcaactgaattttatagcaggtttcaaacaggggcaatgtctggagatatgtttggttgtcataacagagtgggtgctactggcatcaagtgggtagatgccaggggtactgctaaacatcctacagtgcataggagagtcccacaaccaaaaattatctggcctaaaatgtccatagtcctaaggcaaagaaaccctgataaatatacaacaatctacaactctgataaatgtacggtgattgtactctgggtatttactcaagataaatgacaacacacgtccacacaaaaacttgcacacggcatagctttatgtacaacaacccaaaccgaaaactcgaaatatccatggcaaataaacaatggataaagaaattatgatatacccatagaatggaacgcttctcagcaacagaaagaacgaagcgagtacacaaaacatgagtaaatctcaaaaacagtttggtaagtaaaagaaaccaggcacaaagagtatattccatctttttctagacaggtgatgttctagaactggccatgccgaactaggctatacagaccacaggcacttcagtgatcatgttggcctggggataggagagtaagggttgaggttcctcttctttttctttattcaagatggaaatgtgttgaaaattagttggtaacatacagttgtccctcgctacccttggcggattggttctaggacccctgtggataccaaaatctacggatgcttatataaaatgatatacaatggtgtgtttccatgtaattctcctatgtactttaataaataatccctaggttacttacaacacctaatgtcatgtaaataccatgtagatacttgctttattgcactgttcggggaataatgacaagaaagatagtctgtgcctgttcagtacggatgcaccattctttccctggcgcctgaacgtttttgatctgcggttcatttaacctgtgaatgtggaacccacaaatacagagagccgactgtacagtcaaccttcattattcacggattctttatttctgaatttgccccctcattaaatttactgatgccccaaatttcatactcacagtgctttcctggtcattcatggacacgcacagaatggtgaaaaccatgactggcccaatgtgcatgtttccagacaaggctgaaaaaggtgacacgctgtcttcttgtttcagctttcctactgtcctttttgtggtatatttagtgccatattttttgcaattttgtgtttttcttttttttttttttaattttgctgtttaaaatggaccccaggcatcgtgctcagtgctgtctagtgatcccaagtgcaaaaaagttgtgatgtcccttatggaggaaataagtgcatcagatatgcttcatttgggcatgggttatagtgctgttagctgtgagttcagtgttagtgaatcaacaatatatgttaaataaggtgtctttaaacagaaacacacatacaacaaggttatatactgattggctgatgtgtgatcgaaggctcacagcaacttaactttgcattttccctaggttcagtatttgctaattcagtatgactctgtaaaacataataccatgaataatgagaatggacagcatatgtgagtctttttctagacactattacacagaactctgggactgaggctagaggatcactcgaagccaggagttcaagaccagcctgggtaagaagactctgcctctacaaaatataaaaaaattagctgggcgcactagcagtgcatgtgtgtagtcccagctacttggaaggctgaggtgggaggatctcctgagcccaggagattgaggttacagtgagccgtgattgagctgctgcactccaacctgcctgagtgacagagtgagactctgtcttaaaaaacaaaacaaaacaaaaacaaacaaaacaacaaaaactcaaacaaaatgaaattggcaagagtatatctttgccttagcatcttcggagcaaagcaatttgttcctttatcattagttaagctactataggctttttgtggataccctttatcaagctgaggaagtttccatatattcctagtttgttcagagttaaatatatcttaaattttgccaaatgctttttctgcaccgattgaaatattcatataattttatcctttattctgctaatacagaaaattatactgactgatttttgtacgttaaaccttcttggcattcctggaatactttacttattatatatttctgaatttaactagctaagttttgtgaaaggttgatatcagactaatgttagcctcatgaaaaatatatctgggacatgtttcctcctcatttgttttctgagtaattttgtacatggttaatatttcttcctcaaccggtaacatctgagtgacaccatctgatcacggtgatatggtttggatatttgtccccttcaaatctcatgttgaaatgcgatgacccctggtgttggaggtggggcctattgagaggtatttgggtcatgaaggtggatctctcatgaatggcctggtgccctccccatggtaatgggtgagtttctagctctattagttcccgcaagaactggatgttaaaaaaagaaccatggcacttcctttttctccagctccctctcaatgtgacacgcctgctcccctttcgccttccatcctgactataagcttcgtgaggcctcgccagaagcgaatgctagcactgtccttcttaaacagcctgcagaaccccgagcccaaacaaacatcttttctttgtaaatttcccagtctcaggcattcctttacagcaacacaaaacagactaacacacatggaatttgggggaattacaaattcaatttcattaacacagataggactacacagattctattttttggggtagatttggtcatttttatctttaaataaatttgtacatttcccctaagctgttgaatctattggcataaagttgttaacagcagccctttatttattcttctaatgtttgtaatacctgtggtgatgtcctctctttcattgctcatattaatcattcgcgttttctcttttctgttgtttagcccacttagaactttattaattttattgatcttttcaaaggagcagctttagatttcataaattttcagtatctttgtccattttctatttttaatgagttctgctcctatctttattatttcttccttctacttcctttgggtttaatttactctttgtacttgagattcttaaggtggaaactcaaggaacctgacgttcaacctttcttctttttctgttatgaacatttaaagctataagatttccttgaagaactgctctaactacattttacatacacatcttcattagggtcaatatttgttctaatttctctgatgatttcttctttgacacatggatttagaaatatgttgtttcatttccccatattgggggattttccagatatctcttttatttctaaattaattttgttttggccagaaaacatattctgtatttcagtccttctaatttattgagattggttttatacccagaacatggtctattttccttttgctatgggtcacatttgctgcttctttttcttacaattttggaatggatgcttaacattttggatgttggtaaatgtttttcttttctttcttcagagactgatgaagtttgttttgtcgagaaattaggttacttgtgtatcaaagcttatttttaaattgtgttagggtgtagccaatccctttattctagagatactttagctgtattactaagacatagctagtatctctacttaatgctctgggttgttaacagggtctttccattaaggcttgtgagaatttaaatgtatctttgctgtatgtgagttctggggattgttcatctagtagctccatggcaatttttatttgcatagccttgtggaatttcatattatgcatgcaaggattagtattcagctaaagactcaaggggtcccctatgtagatttctggaactcttcctctgagtatctccactttagtattctgtcttgcaaactccagctgcctaggccttttcatagtctattttccctcaactcagtgagacttctagttctgtttaaagctctgtctcttcactacagtctagaaagcagctctgaatataaatctgagatgactacagtagtcacctaatttatttcccttcatgggatcatgattctgtactgactgttttccaatgtctgaaaacagtgatttcatatattttgggtagttttctagttgtttatggcaggagggcaaattctataccatttattacttcataagaagaactagagtaatcactcaaaagtacgaacctgatgatatcactctccagcttaaaacccttccatgctgactatataatttgctgtctatactggtatatttctgaagtgctaaaatgctaaccagaagaagtgctggtgattcacaatagcaatgatatggaatcaacctaagtgcccatcaatggatgattggacagagaaaaagtagtgtgcatataaacacacacacacacaccatggaacactactcagccatgaaaaagaatgaaatcatgtcttttgcagcaacatccctggctgcactggaggccattatcttaagtgaaacaatacagaaagtcaaatactgatagtctcacttataagtgggaactaaataatgtgcacacatggacacagtatgtggaatgacagacactggggactcagaagggcaatggctggggggcaggtgggagggcagtgagggatgcgaaattactaatgggcataatctacattattcagatggtggatacactaaacgcccagattttaccactacacaatatactcccataacaaaacagcacttgtagtccttaaatttatccaagaaaaaggtgtggggataatgagcataaaccaggatgatcacaggaaaactagcacttctgtcactgctaaactcctcggctcggcttctaggctctcattacttcccctcctcatttccctcccaccttcattcctttagcttgaatgcctctacagtgctgtatttcttacgtgtagcaactctcctctcctgttcatctagtaaactcctcttctgccctccaggtggttgaaacattaacttcctctaggtctacacggtgctttgcacctgatttggcttgcacctcatgctattctattaatttatttgcatgttgcctcctcttctagactaggtttttgagaaagtgagagaaaaatcaagaaatctgttttagaaaaattaatccagaaacaatatttgtgaaaaattggataaaggatgaggaacaggggcaatttagaagattgtttagtatctatattcttatttaacagcagccttcagagctaaagaagcccaaaggcctcttaacacctaatcacccatttattcctcttaaactctcacctgcaatcaaaacctattcagaaaaccagaattttaatgtaaagatctcagtatgaaggtttttggtattttatgatctaaacaaaccttccaaagtctggtgaggctcaagttggcaaaccacctgcaatcttcccactaaactatatttagtatcccactgtagcacccactgcaactgacatatgaatacactgtgctaacaaatacattacttaatacaaaactcttcaatttattacattgtgtcataaatttgttttgctttataagaaaatagattttaactcaaaaagtttcttatttggaacaaatgcatgaagcaaaggttttcaagcactggacatcaagcaaccaacaacttaattcccaggaaatgaaaaactgatgaggcaagctgtatgactgccccagcttactgcactaagaacttctgggctatagcacagggaggggaaaccatgagaaagcccagtgaacacactgagctgagagtctggggagaacaagttgacttgagtttgctgctcaggacacaagagcggagattgctgtacagagagaatcttgaatatctgcaggtcttccttgagtattcagcagagttctgagtggcacaagtacatgaaaaaataacctgaggctagggaaagaatcatctgaaaggattacagaaaaaaataccaggtgcttacaaggccaggaacagaaattgtgctcaccagccagactgtaaaaccttataattaacagggcattggatagagcactcaaaagaatcttgcctcagaactaggcaataattagccatagactaaatgatgctctttctcacctgacaaactgtggagacaaaacccaaaacaatcacactatttccaagtaacttaactacatcccagaacaaagcacagggagatctgtagaaacacaaaaaagcaaaactctgtctgggtccaaccaaagattaccagatagacagatcaccatacgtgcaaagaagcaagaaagtgcaacccatagtgagaaaaaaataagacaacccagaaaggccacaggtgtcagacttattggacaaagatattaaacagttactatttgtaatatgtatgtccaaaaagttaagtagagacatagaagatataccaaagacccaaactgagttttcatctagagatgaaaactatatgaaatgcaaatatacattgaatgcaattaatggtagaatagagattgtaaaagaaaacattagtgagcttgaagacataacaacagaaactacacaaaatgaaatacagagagaaaaaagagcataagtaaactgcagaatgacttcatgtgtgatctaatgtacataaaattggagtccctacaggagaaaggggagggtagaaaatatatttaaataaataatgaaggaacaaaactgtaacatttgataaaaaacataaatctacagatgtaagagactcagttatgataggtacagtaaacatgaagaaagctacaaaaggacaaagtataatcaaattgctcaaaaccagtggtaaaagagaaacatttaaaagcagccagagaaagacgaaacagagattaggattacaacagatttactgttggaaacaatgcaagtaagaagacagtggaacaacatctccaaaacatggaaagaaaataaataactccaaaatatatatatgacaaaaatatttgtcaaaaactaaggtaaaatacagacattttcagatatgcaacagctggaaaagttcataaccagcagatccgcactatggaaaatgttaaaggaagcccttgaggcagaaggaaagtgctaacagacggaaatataaatatacccaaagcaataaagagaactgaaaaatggtaagtctattaaacatattttataatttgaatatgtttaaaatataattgattagttaagaaaaaaattatatttttggagttgataacatatacaagtaaaatgtttgacaacaataggaaaaaggtggctggggaaggagtaatgaagaattgcaaggttcttacactgaacatgaagtggtaaaatattacttgacagtaagctaaagatgtctactataattcctaaagcaaccactaaaataacaaagcaaagagtaatagctaataagacaacaaatgagattaaatgaaaacaaaaaaataactcaatgcaaaagaagacaggacaagaggaaagggcaataattattcaattacattaaataattgcattcaatgctaactgcattgaattacattgaatgtaattattgatacggttaggattgtctattttccatcctgtttttatttatccaatcagataaataataaataatatatgtaaacactataaaatcccagttaaaagacagaaatgagcagactgcattaaaagatcaagacccaattatatgctatttataagaaatatactgtaagtataagaaaaaccaaatagattaaaataaaatgatagaaatatatattacatgctaacattaatcaaaagaaagctgaattggctatattaatattaaggtagatcttaacgcagccagggataaagaagtttatatcacattgtctaacggaccaatcaatatgacgtaaaaatctaaatgcttatgtgcctaacagcagagcttcaaaatacacgaagcaaaagtgaatacaacttcaaggagaaatagacagtcccttaattatagtcagagatttcagtatcctgccctagtaattgatagaatacataggaagaaaattagtcagacttttctgactaatgtagccttgaacaacactatgacaccatggtctaggtagaaaatgtaatgaaatctacagaaaaagctactaaaattaataagttagtttcacaaagttgcaggatacaagatcagtaaacaaatataaattacatatctatatgccagcaactagtaaatataacctgaaatttaaagataaatgccatgtatactagtatcaaaaataaaacatacttaggaataaatctgacaaaagatgttcaagtcctgtatattaaaaactataaaacactgcagagagaaattaaagagatctaaatctctaatggtagaacagagattataaaagaagcactagtgagcttcaaggcataataatacaaactacataaaatgaaacacagagagaaaagaatagtgaaaagagaaaaaaagaatataagtgaacggtggaatgactacatgtgtggtctcacataaaattggagttccctaaaggagaagggggagggtagaaaatatacttgaataaataatgaaagaaaaaaagacccttaacatttgatgagaagcaaatagagagacataccatgttcatgatttggaagaatcgatattgttaagatgccaattctttctaaattcatttgtagattcaatgcaatcataataaaaatcctaataggctttttatttgtgtggaaattgacaagttggttctaaaatttacacagaaaaggtgttaaaataaccaaaataacttgaaaaacaagaataaaatcgaaagattatactatttgatagaaaatcatacagctatagtgaccaagacagtgtgataccagtgtaaggactgacaagaaccaaacagagaatccagaaatacaccacatatctacaaacaactgattttcagcaaaagtgcaaaggcaattaagtggagaaaggacagtatttcaacaaatggtactggaataactggatactcatgtgcaaaagttgaatttccatccacacttcacaatgaatcttaaacccaaatgtaaagtctaaaactgcaaagtgttctgaacctaacatagaaaaaaatccattgtgactttagattataccaagatttcttagccacaactccaaaaacaagaaccataaattaaaaaatgtaaaacagaacttcatagaaattaattttttaacaaagtttgaaagacatgtctttacaatctctaaagacaagccccatacttagagaagatatttgcaaagtatgtaaataacttgaatgtagaacatataaaaaagacttttcaaaaatcaacaatgagaacaaaacaacctagtaaaaaaggccaaagttttttgaacacatcaccacagaagatacatggatggaaaataagtgtatgaaaagatgctcaatacaaccaatcatgaaggcaatgcacattaaaaccacaatgagataccactacatacctattagaatgtttaggattaaaaagatcaagtgttggcaaggatgtggagaaacaacaactctcctccattgctggtagagatgtaaaatgatataagcactttggagaacagtttagtgggtttttaagaaaatgttaaacatactcctattatttgatccaaacattccactcctaggtatttaccccagagaagagaaagcacaaagacattttgtgtgttataaacatgtgcacaaatatttataatagcttttatgtataactgcccccaaatggatacaacccaaacgtcctctgacaggttaagggataaacaaattttgttatgtccatacaatggaatacggctcagcaatgaaaagtaatgaacaattgatccatgcaacaacatggataaatttcagaataattacacagagtgacagaagccaaacaagaaagtacatgctatatgattctacatatataaaactctaggaaaatgcagactcacccatagtgacagaaagcagagcagtggtggcctggggatgagtggggtgtgtggagaagggtaggagggatcaattacaaggggtctgagaatgaatttggcaatgatggatacattcattatcttatcaaaacaataataatgcaaattctatagcatgagttacttacatataattatacatatgtgatattttcaccggtatataccaatgtgaaagcttaccaaattatctaaatatgtgcaatttacatgtcgattatatctcaataaagaaatgtgaaaatgatacttcctatttcttcctaattccatgcaatttagacttcatacatgtaatactttctgtaagctcccagcaaggtttctttcatcaacatcagctaaataatttggagaaatttatcagaaatttcaaagtatgtcaacttcaatttcttcttgtaatttcataggttaactttcttctctaaccttagtccaaatgcactacaaaatattttctcatgctttcattaacctggtcttcagtgcttcaacagattttggtgattgtaatatttacagagtcaacaaagtgaagccaatagcactactgattggaaaggcaggggtgggcccctaagcaaggtaacccgcagaccaagcaggagactgtcctgagcagatacttccccactctgaagggagtctcaagttcccactactgaagcacagaacttgtacttcccatttccttcgggacaatctggatgcaggaggctgctgtgctaaaaagttttcaccatgtcactagcttgacatctacttttacgacctctcattcttaattatgtccctgaatcccagctcctgagctcatgtatttatctttgtccagaaaagcggaaattgtaaaaacaaattctatagcatgagttacttatatataattgttatgtggggtctctattatttcaagtcattaatcagccaagttccattattttctgtaagtcaatccttttgccactcttcccataagcacctcccaatagaactatttcctttgttaaatgcatgcatatgcaggtttttacatgtatattatgtatcaattatcatataattacataattactgtaatcggatttaactgtataattagaatgtgtaattacataattaaaacatgtaattaccaagtttaaaaagttatggaaattatttcttttaaatgaataatgcatgtatgggagacaaactttcaaagctcactacttaggccttctaaaagtcattttaactaaaaacacaatttaaaatccactaagccagttatttcacatgacatgttgaataccttaaacttttttaatggatttttatcttaagagaatattagaaaccttcaagggctcagcatctggatgtaggaaaaggagacaaaaaggcagctctcttcaagtgatcatgaagtctgactgcatttttaacctattcccacttacattaaaagttttcttggctgggcgcggtgcctgtaatcccagcactttgggaggctgaggtgggaggactgtttgagcccaggagtttgagacctgcctgggcaagatggtgagaccctgtctctacaaaaaattttgaaaacttagccaggtgcagtggtgtgcgcctgtagtcctagctactcaggaggctgaggcaagagggtcacttgagcccagtagtttgaggtggcagtgagctatgatcatgccactgcactccagcctggccaataaagtgagactctgtctctaaaaaataaaaagtattttcctagggtgtctttttttttttttttttttgcagctattgtaaaagggattcagtttttgatttgactctcagcttggtcactgttggtgtatagcagtgctactgatttgtgtacatgaattttgtaacctaagactttactgaattcatttatcaaatctagaggtcttttggtggagtctttagggttttctaggtgtacaatcatattaccagcaaaaagagatagtttgacttcctcttttccaatttgaatgccctttagttccttctcttgcttgattgccccagctacgacttccagtgctatcctgaatagaagtggtgaaagtgggtatccttgtcttattccagttcttatggggaatgctttcaacttttccccattcagtatgtgtgggtttgtcatatgtggcttttattattttgaggtatgttccttctatgcctagtttgttgagggtttatatgataaagtgttgctggattttatcacatgcttattctgtttctattatcatatggtttttgtttataattatgttggtgtgatgtatcacatttattgatttgtgtatgacgaaccatccctgcatccctagtgatcatggtgaattatctttttgatgtgctgttggattctgtttggtagtatttcattgaggatttttgcacttatgttcatcagggataggaagtgaaagatctctacaaggggagctacaaaacactactgaaagaaataatagatgacacaaagaaatggaaatacatcccatgctcatggattggaagaatcaacatcataaaaatgaccatgtggctcaaagcaatctacagattcaatgcaactcttttcaaaataccaacatcattttcacagaacaataaaaaaaatcctaatattcataaggagccaaaaaagaggctgaagagccaaagcaatcctaagcaaaaagaacaaagccagaggcatcacacgacatgacttcaaactatactataaggttatagtaaccaaaacagcatggtactggtataaatgtagatacacggaccaatggagcagaataaagaacccagaaataaagccaaatacttacaaccaactgatctttgacaaagcacacaaaaacataaattggaaaaaggacaccctattcaataaatggtgctaggaaaactggacagccacatgtagaggaatgaaactggattcttatctctaaccatctacaaaaatcaactccagacggatcaaacacttaaatctaagaactgaaaccagaaaaaaatctagaagaaaacctaggaaaaacactgctggatactggcctaggcaaagaatttatgactaagaacccaaaagcaaatgtaacaaaaacaaacaaacaaaaaataaatgagacctaattaactgagaagcttctgcatagcaaaagaaataatcatcagagcaaacagacaacccacagaatgagagaaatatttgcaaactattcatgtgacaaagaactaatatctagaatctacaaacaactcaaacaagtcagcaagaaaaaccaaataatcccatcaaaacataggcaaatgacatgaatagacatttttcaaaagaagatacacaaatggccaaaaaatatatgaaaaaatgttcaacatcagtaatcatcagggaaatgcaaattacaaccacaatagataccaacttaccacagccagaatggcagttattaaaaagtcaaaaaacaattaatgttagtgtggatgtggtgaaaagagaagacttatacactgctagtgagaatgtaaattagtaccacctgtatggaaaacagtatggtgatttctcaaagaactaaaagtagatcaactgttcaattcagcaatcccactacagggtatctatccaaaggaaaataagtcactatgttaaaaagacatctgcacacatgtttatcgcagcacaattcacaattgcaaatatatggaaccaatctaagtgctcatcaactgatgagtggataaagaaaatgtgatatatacaccacaggatactatttaaccatgaaaaagaatgaaataatgtcttttgtagcaatgtggatggagctgggggccattattctaagtgaagtggctcaggaatggaaaaccaagtaccctatattctcatttagaagtggaggtaagctatggatatgcaaaggtatacagagtgggaaaatggactttggagactcagaggagggaaagatgaaatgcgggcaagggataaaaaacaacacattgggtacaatatacactacttggatgacaagttcactaagatctcagactccatcactacacaatgcatcttgtaaccaaaaaccacttgtaccctaaaagctattaaaataaaatatatgtattttaacaagttttcttagtgtaattgacagcaaataatgagcagtgatgactagtacaaaagtcatcacccagctgatgttttggtaaatccaggaaatggtatatctgattcaatcccatgcttggtttcaaaggcaaaatgttacttaaaaaaataaatgttgactatatacctgcttgataataagaaacattcacctctcttcgtttaagttcaacttaaagaagaaacatttttgaaaagtgagaagtgtgttacattggtggtattatgataataattcaagtgtgcttgatgctggggataaaatgacaaatcagatgtgttctctggccttgcgttgttcagacaaacacatgagccaataaataaaacacaaagagaatatggacagtaatggctttcaaaacttaaaaaaatctaataataaatcattacaatttgttgcctgaggaaataatcctcatcatgtaaaccagaagtcaattattgatttttctgaccacaatcaacaccacagccgagtatgctctgtgcaggaaaatccctactcctcttcagacctgcctgtaacactctatacatatttaatcattaataacataacacttatcctattgcttcacaattatgtatatgtctatttcttcttttgaatgtgagttccaggagggcaaatgcttagcgcaggaaacatctgcctgcaggagtcttacacacacacacacacacacacacacacacacacacacgatgaaggaacatttgcccgctcttttcatggaacaggatgcttttgtttttgtctcttcacatcacaagtaaccagcacatctttgaaaactcaacagtttaacctggaaatgttcataaagatcattctcaaatgacaacttattcttggacaaaataagaaatgcaaatgcaaaataaaagaatgtgtcccacagagatgatagaaaaaaaaaagagcagaacagttatagtaaaccacaggctaaaccctcatattatgcattgcatcagccatgataaataaggttcgcatttgtcagatccgatcaacttggtttctagggtagtccaatttcagcagactgctctagcactaatcatcttgtgaattcatctgtggtaggttaatgttcaattcattaattaattactcccatcaacattcattgagcttctgtctactacatgtgaagcagcatgtggggtatgggatatgcaacacagagcggaaaatagcccctgctctcatggaattcatgttccaggaaaagggcagacacgtaaacaagcctaacactgcaaatgctcagctctgcgatgggagtgtgtgccaggaccccaggagcatggaggaggatgaggacccctgaacaaattcaatgcgatgcaccaggaatctcgctccctatggctccctatttgtttcctctggggaaccactccagacttgatggggggaaatcccagttgaacttgatatgacagagcaagtaacttagaacaacactgattctgcagaacctggactagcagacctactagtcacaggagtcctatcccttcttcatatacctgtctccacgcccccaccctcattcaagataaaacattcaccagcattcctcttaatgcatctttgttgggaagatgactggagcccagcacagtgtatggcaaacagtaggcgctctgtgttgaatgctgaatacttacatgaataccactgagaatccacagtaaaatacatttgtgtgttttggttttgttccaacagattttcatcatttctgaagaaagagacatactcctggaatgtggcacatggaaacttcctggtttatcaggagttgatcatgacctctaagagctcaaagctcagctgaggcttttgcagaactgggaagcatggcattcgtctcagcctaaccccccacattccctgtgttgcttgtgtggtgttactggcgccaccagggctatcccttgcattcatcaacagataccgagagaaagttgctgttcccatgttcatgaattgaacctgtcacccatgaatgcacttttggctcatcagattagctggttgtcacctcataaatgaggaaacagggtcctggatggaagaggatggtgcataggacaaggcagagaaaacggagtggtgggtgggttgctgcatggtctgttggctcccgaagtctaataagatgacagaatctggagtttggaaaggatcctggactcaccatgtacctaatgcatgaattcctaccaacgcacccagtttctgttcttcctgggatggagaactgtcacatcccctaattgaccatttggctttctgatatctcagctggtggaaaggtctttttgatattgagtcccaattcataaattctactccgtggtcctggtttttcactctgaggtcaaaagaaccaatctagtcacctgatgctgtgatcttagtcctgaaattaagagtcaatattacttgctgccttgacatctggtaaaataaggcaggcctcaattggcctaactgcaagttctccccacactgcccctatggataaagtcttgtagcaaaacaccctctttagcagggggaccaggcacagttcctgcttatcgctgagtggcgggtttagctccctgccagcctgtggaattagtcaaacaagccaatcacatcctactgtgagaaccaggggtcaacctaccctcttgttactacaaagctggcctctggcagtccccgctggctcactctgttcctgaatacaacccctctgtgcccctgagccccttcccaggctgtgagtatatgtaattaataagtgcctgtcaatctcatctgttcattgtcaggggctgtgtgttcagccatacccatcaccatagggtaggaatccctccctcgccaatggggtgaaggggaggcaaccaaaatagctacgtcttagaacgaggctctgggaaccttagaagagtgggttaaagagaggccggaagaactctgtttgattagaatttaaaattcccatttcctccctctttccacctttcctaaacaccactctcaaggttttctcaagtgactgtgggtatggaagctgatgtaacacaatggcaggaaacaagaacaagaacaagtgaacaaggcagaatcaagagagccatactttaggaaaaggtatacaaagaaatattctgggatcccaggaccatcaatgacagtaaacttactctagaaaataagtgtcattattcactggattcaccagcacactctattgttcttactgtagttctttggctaccagatgcccaggtaccagaactctatttgtctctgtatgaaaatacagagtgatgaacaagaaaactagtgattacaactaatgcatgtgttctagttacaaacacaaacctgcccctccccctcctctgagctaatggatgaacctcaatcaatacactcaggaaagactgcagaatcaataacaaggcttatttaacagaattaagaagtggctttttaaaaaacaaaagaaaaaaaaacaagaaagtagacacaattgcaataactgcattcttatgttgcctggcaacaagatataaaaatgatgtacaatgtcagtgacttattttcacatagagaagcagccccctgccttggcaatgctataatgtactttcccccaactagaactccacagagactattaatgctaccattttccataatacactgttaaacaatcatgtgtttttgttagtgcattaaaacactgaatttacttaatgactactcagtgaggcagcggctacagaaaagggaggagtttttgtttcctttgcaagcacaggagttcgttccctgggcaggagaatttaacaggtagcaatggatatgaatcaaagcactggaattcacatacctagagaggaaggtgcactcttacgtcttttcaagggaaagcagaaaatgaagtcgaagtgcagtattagtgttccttgactttaaaaaattttctttagaatatgaaagaagtttctggaaggcagaaagcctttgaggttccaagacatatacttggacatgggagtgaaggttcaatagaaaaggaaagtgacagcagagcgctttagctgagaagaagagaagaacaaggagcggctacagaggcacccagctctcagggtctacggggcaagccctcaacgcggggggctggcgctcctactgcagcctgcacctctggcagtggggagggggcacaggtttgcaccctgctgggggtcacacatacattagctcatttcatccttctatgaaagcccattcaatagaagcagaaaatagattcaatgggattaggtgattacccagtgtctgtcggctagtgaattggaaagctggaatttaacactaagcctgtctgtcctcagagccaccacacacctttgcctccattggctgtcactaatttccagctgtaggggatgttctgggattgctgccatttagtgcccatggagcacaagtaaggaggaaagctatttcctccaaagaagcaataaaacaaataaaaaacaagaaaccactttcctgatgagtcccacatcccactgcgctgtatttatgtgcacatttgttaacttgcacacttccatgattttttgcaagcttcttactcattgttcactaactcctttggtacagggccaggtgttatatttttataagaaatagttttaaaacaactgttttctgctgaatagagcattttattcaggagacctccagtaaatactgatggacaacttgtgggtaagggaaaggtcactttgttttacaaaatctttgggaaaaggaatctgtcttattcacagtgctatcttcaacacctgcactggactacagtaagtgctcaataaataggtacaaaatcaacatcatgcactcaggaatttcaaagtcttcctgatatgctgatggaccagtgatttttactcaggatccttgggggcttgaaccaatactggtacctcacagcctaactgaaatgagcaaaaaagatggataacgtgaagtggaatgctgtggttatggaaagggcagacaattataggcaaagacaacttgatgtcagctcagcatcctcccggttgctatgcaaccccagagaagtcccttgtcttacctggccgctttaacctcaccacacctgttcccccatctgagagataattacaacacttactgtgtcaggcagtcaacaagtatttatggaatgcccacagggcacagagcaataaacctattgcttacttaagccaggaaatcaagctacagcaaagcagaggattagtacaaatacctgggcaaacgtgccacccgcagaagcattaggttcttaaatcctccaggtaattgtggtcacacattagtcttggctttagggccttttaaagtagtatctgaaatatcttgtctatccactttagttcaagtgtgtgagtgtgtgtgtgtgtgtgttggctttccatctccgcttaacaaatcacctcaaacttagtggctgaaaacaacacagatatatgatcttagagtttgaccgctaaaagtttaaaatgcatgaaaaccaaggtgctagcaagaccacgttctgttctggaggctctaggggaaactctgttcttgctccttgcaatttctcagggccatcacattctttggtttgtggcccctttttccatcttcaaagccagcgacactggacaagtctttctgatgctctcatctttggaattctctttcctctgtcttcctcccccacatctaagggcctttatgattacattgtacccatccagataatccaggataacctccccaactcaaggtggatgattagcaactttaattccctcttgccatgttacctaacatattcacatggtctgcggattaggacatgggagggacgtgcttttctgcctaccacatgtgtgtctggctgtaattatttatctattgagagcaatgaaaggtcattcattctatgggtacaactcaggaccttatgtaagatcatctattgccttcagaactttatgctctcaggaaggtgataagtatgtaaaatattaacaaccaaaaccaaccctgtagtttgcaaagcactttgacattcatccttttggttagaacctctcagctactttgcaagacaagtaaggaaactattattatctctgaatcacagatgagtaaactgaggcacagaggttttttggtttttttttcccttaaggacagaaaacagcatattcaaaccgaggcatgtgggtttctggtctggtgctctttatcctccccgtactgcaaacacctttacagtatgtgtcatattgacatatgttgccaaaagaagagatcctgctcctatttcatgaaaggaaaacagatgtgaggttgttcagaaactcaataaagtgcataaagtatgccccttgcagagctgaggcaccagattctccctccattaattcagtcttatccctgatccatgcttgcaaagcaagagacaagggaacgaaaggacagaaagaatttctacaggttgagtcaccatttggacgcagaacaacgtggcaatgtgggcacttcatgcacacagttaaaataagtcacacgctttatgtctgcatattttctttgtatgaataaaagaatgcagctgtacgatggccttggccttgtgtggacagtggtagctacgtacctgaacacagacaatgagagaagttgagaactttcattaaaatatttcagtcatgtaagccaatgagcattattttagtctccataaagctgcattgtttcaatagagaatccaaggccagaaatgtgctcattctaggcacaatctcacagtttgtcctgatgtcttaccttgagggggtgtgggcaatgattcttgtgcccaatgcaaagagatgccctgatgattagtgtaaggtggccaatcctgatgaccaggttcagacatccagagcctgccagccagcaaatcaggccctacattttctccctctccattttttcctttcctttccagaagcggtcagcttctagaagccacccacagtggcctctacaaataagatgttacttctgaagtaagatcattgtcttccttccgataccctctgacgaaacctctgaaggtgaaacactagcagaggctgaaaagtcatgatcacctgctggtaatgccccacaaaggcacggaggacacacgtgctgagcagtacctgatgcagcagcctctggagataagactttccccagaatccccaaattctcacgtacacggcatcgtccatgactctgacagtcatattgatgacagatacgaaaaaacatggtcgttggtatcatagaggaaactacataaatgtaaatgcataaagggaagtcgagtgtgactccctttcttaattgtctaacgcaattcccactagatgcataaattgcagttcctattaacggcactatgaataataatcggtttactttctgacttgtatctaaatatactttctatatgatttcatcttttattcagctgtttaaaagcagaacatctaattacagttcctattagtcaacattaattttttttctttttgccatggagcatgtgtgatgactgattttctaaaaacagaattctttagcatatggaacaaatcgtgttattattaatgcattcccagatgactctgcatatcaattctcttaattatttagtcattgctgattatgtctttttataattcattaccctatttctcgcagtgcaggcattttattcattaagtgtcaaaatgaagggcttgacctccaaaaaaaaaaagataatcaggaaataccgacacagttttacaagtctgcgcttcccttctggaacattttcatgctgtgtgataacatgctttaaacaacttttccaaggacatcagtaggtacacatgacagggttgcaggcagaggttggagggacgtcgagcaggggaggctgtggagttgctcacacgaggtttttctaaagatgagacggcaccagttccaactacagctcaatcacactgccatgttctcattctaaacaaaaatgccatttgtgtaatagatttttataccagttttattcaaaagctaacaggatgcttccaaaagagctctttaagtagtagtactgggaagtctaggataagaaacatttactaaattaaaagaggactaggtcttaataagaattcactttgccttcaggctgatcctactgaagttatgaaacctgacctggagtacataacaaggcctgtgtactacgatcctcatgctcatgttggctcattatttcagtgaggtctgtgcaccttgtctgagaccaaattcattacttagaaaaggcaaataaaaaatatgaaaaagaatcaaggaagctgagactgtgaggagattaaaggagaacaaacacacctacttctacctggttagagccttctctgtatctaagatgtcagcttcacacagatggaattttgggaagaatctccccaggcttcctcaacaactctgctttatttgtaacctagatggtagccactacagtagcaaagatcacagtcacatagaacaaaacagttcacctgtttataaagtgcaccttccagctaaacacatggctgctgaccctaccaagttgagtactactgagcaagttgttctaatgaaacccattctgtctgttttctgactaagagcaaacaatagatgccaaatactcaaagaaggggtgtacctaggcacagccaaccttgcaatggaggggtccaagaagagtgttatgaccttcagctcaatacccacctgagggtctacaagggttgaagctgaagaggccaagaaagaaactttcttgggggaaagttgctgtagtatgtggcatttttcctcccctatctgtagtgggtaaggggatgacagatatttctttctcacctctagcctaagtaaaagagcttctaatcacacaaaccaccaccaccaccaccaccaccaccctcaaaggactttatatttgttctgggggcttggggataactaactgaagcctgaaaaagcccacaggggaaaggcaactgaatggcctgagatatagcacagaagggtatactggatgtgaactgcactcccacctacagagagacaaaatatactactgcatgcagaagctgagttggagcacgcatagggaaggaagggcaggtcctggggaagattgaaagggaggcactaccttcatcaagggagctacagcttgacattcacatggggaaaatctttctggaaccatgaaaacatcccacaagaaaaagaaccctccaatctccaatgccagctcacaggaatagccaagtaagattgttccagccccttaccactcttttatcacactagctccggctcctggaggagccagggccccagctaaaaaataaaagaaggagaaatacaaggcagtggaagagagaaggggcaaccatgtccctccacccctcccaggattacagcccaaagaaggcccaaggtggaggaaggaaaaacttgaagtttagagctttgactatgccatatgatttggcattttaattatacttttttttttttttgagatggagtctcactctgtcacccaggatggagtgcagtggcgtgatcttggctcactgcaacctctgtctcccaggttcaagtgattctcatgccttagcctcccaagtagctgggattacaggcgtgtaccatcccccccggctgatttttgtattaaaatgacacatttttgtcactaagagtgactggagaacttttttattatataacaatgtctagaaacaccatggaagctatgagatttcatccaggggcaggggaggaagtagcccacaaaaaaggtctagagagacaatgagaagaaaaatagagttgctttatgatcatgaattgttcagtcttattccttggatgtatcagttgcattttttattatagcaaaatataacaaaattttaccactgtaaccatttctaggtgtacagttcagtttaagtatgttcacactgttgtacgaccagcaccaccatccatctgtagaacttctccatcttcccaaactgaaactccatactcattaaacaatatgtaatgattgcattttaatgagcaaatagaagaattcagcacaagtcccggctcctgcctttggcacttactccatgctgctgctgctgttttacttttacttattcaatttctgatgctcttattttctttgtgtagatctgactttctgactatatcatattccttctgcctaaaaaattgcctccaacattacttgtagagtatgtccactagcaattaattccctcagtttttgtttgagaaagtatttctccttaacgtctgaagcatatttttgctgtgcatagaattctgggttgagagttttttttttttttcctctttcagcatgttaaagatgtcaccccactgttttcttgcttgttagtttctgacaagaagtccgctgtactacttatcctggttccttctctctctctctctctctctgtgtgtgtgtgtgtacatggatatttaccttgcaaggtatcctcttgagtttgagcttctggggtatgtggtttggtgtctgtcactaattttggaaaattcttggcccttatttcttctgccctgctgtctttattttcccctctgtgattccagttacatgaatgttaccatttgatattatccaataggtcttggatgatctgttctttttttttttttttaaatctcattgcatttcagtttgggtaactttggttgacttatcttcatgctcactgattgttcaatgatgtccagtctattgatgaactcattaaatgcattctttatctctgttttccattttaaaaattttttatttggctctctcttgtagtttccatctctttggcgacatggcctatataatcttgcatgctgtttaccttctccataagagccattaacatattgattgtagccatttaaattctttgtctgagagttctaacatctgtgtcaaatctaattctacttctgatgactgctttatcccttcagactgttatttcttgctgttttgtaagtcttgtaattttttgttgaaagccaaacatgtcatctaggacagtggattccaggtaagcacattgcatgcttggagatgaggatgccttcctcctctgttagttcttcagtgtggaggtttctgttaatgtggtcaggagtctagttgtttgtgaagactgctatctgcttggctatgagtgtccctccttggctttgggtctccctttgcatggttctccaagttgtattccactgttattcttctcaaagcttgttagtgtggtggttggagagtggaggagagaagatggtatctgatgttccgattaagcctcagcctcaggtaggcactctgaacaagagtcttggtggtgtgtccttcacaagtgttcctgagctttctccagatataccgtaatgttaggtagcacacattcctgccccttccccatgggtagagttttttgtgttcttcttttctcctcctctgggtacagtgagtttccaccaggaacctcaggatacattttggttgcccttcctcctgtagattagggcatttgtttcttaggaatgacagggaatatgattctgagttgaatattgctagtggttgccattcttcttccccttctctagagggatccaccagtgccctcaggctgcagttctgtatccttcctgaagattaatgttctagtcagtaggagagatgaaggacatgggttcagctagaggttctgcagtggctgctgttcaacttcctcggtcaagaccacaggaaaggcttctcgagattctcccaggtcttcccttggggcacctggcagaggagacgcctacaacaaagtacaaacctccccgggtctgccaccctctcctgcgagcccatgttcagcctttagcaatttgtttaaagtttctagccagatcttcttactggctcatacggtcttgtgtggtgttccccatgtaagcaaatgtccaagtcctgcttcttcctgacacgtctatctctcttcatatttcagactgttgttttccatgctatttcagatctcccaaaggagttttctgtttctttggctttttttcctgttctaagagggggattactgctccttccagattactgcctttagctctgagttgaaatattgctgagtttttattttgttttgtttttagagatggagtcttactatgttgctcaggctggctttgaactcctaggttcaagcaatctttccacctaagcctcccgagtagctgggactacaggtgcatgccacggtgcccagcctgttgctgttttatcagcactttaccaagttgtgtgcaatctttaatctctgagctaaacaactagcctgggtcaagcacatgttgcagcttccattgtcggagaagaaaatgagttagaaaacttattactgtatttactacattgaatatgcatgaccaatccttcattttcaagtaatcacagtgtcattataaactctaaattcactcagaagtgacttcttatcagaagtaaaaaaacaaagtttataattttagatgcctttgccttcttatgaagacatatgcagaattccatctctgactcgtttctggaccctggaaataactggctttttatagcaataactcaagggactgaatataatttaaaagtaatatacccaatacaggttgagcataccaaattccaaatttcaaaatccaaaatctgaaatactccaaaatctgaaagtttttgagcaccaacatgatgctcaaaggaaatgtttattgtagcatttaggattttagatttgggatgttcaactggtataatgcaaatattccaaaatccaaaatctaaaacacttacactcccaagcatttcagataagagatactcaaatcattaaagtacttattgagactattaggtgggtgctacaaaatcatttcccgacagaaatgtagggaatctcattctaatcaaattaaaactgtacatcaatgaaaaatacaacgttgaaaccgacaatccttcatccatggtaaatgaatgtcaatcaatttcccctcctgtgtctttgtttaaacgtctatgtaaagtctggagattttctgagcctatctctttggcaactcccactattttaattcacagtcctttcaagtccaagcaaatttctgagtttcacattgctctcctagttggataaatctttatatagaaagcacttacatttcagtaggagggtttagtcatttgtcaataaatgagatagctggttcaagcaatctaccaagtttatttctatgtgaaaatactgctagaagttagcaggtatacatgatctacatgattttaaattctttgtgaattctcaaaataaatctttagaaatatagtatactagaacatgtattataaaaattactttgcctgggtaatctaattcatcattgggcatacttagtatagccatatatacatacttataaacacaacttacaggtataagttgacataaatgaacataaactgacaatcaactaagaaggcaaagacatttaaataagcacattgtatttaaagagataaaaagctatcaactacctatcaaatgaatgttccaccagggggtgtagtatgcatttattatgtctgcagccaatttacctggcgtatgcacctaaaaacagttgaacaaaaagtatatttttgtagaatgatttatgacgtcccactggctttcatttttattccaaggaagctttgtctgtatattttattgcttttcaattaaatccaaagttatttccaacacttttggttttcaaattaaagctaagttgtaaagaaaactgtaaacaaatatctagattcttcagggaagtctgctattaatgctagattaattctttcctatagccaagaatcttttagcaaagcaattgtttcttagcgttaaatacaatctcacaaatattctacaaatggattttataggttgagatttcctttaagtaaagctcgtcgctaatgaatctggaaatattcagttattttaacaagaataatagcagctaacagtcattagtcccaaaataaagtgtttccttcaatctcagatttacaaaattggtttacctccacaaccacatttgatgaatgaaaacattttattagatatgttgattcactaagatgtgcgtattcacaaatttatccagcaatagatgtaacaagcatatgaaataataaatgagaacagtagcttttttccttgcaaaatgtacactctactgacatctatattgggtcagcatcacccagccactaagcaccaaagctgttgttgaacgcaggagtggctgatgctaaggctcaagctctggtgaaaacccacactgtgtggtcaggggagccggagcttctgccactgggaaactcttggtttctcctgactctccatctttaccttccccctcctggggaagaggacagccttgcctgttgttgctcttactgggggtaatgtgggaaggatgcctccaccaggaggtgccagtcatcatagagctccatggaaggcagcacagcacaggcggatgcaaaaagaatccaacatttcgagatgcattattcagtaactaggttacacatgaatacacactcaagatcaatttgtaaggaactatcaaaggcacagtcatgcatcgcttgacaacagggattcattctgagaaatgcgttgttgggtgaattcgtcgttgtgcaagcatcatagagtgcacttacacaaacctgggtggcacagcctgctacacacctagcctatatggtatggcctattgctcatagcctacaaaactgtgcagcatgttactgtactcaatactgtaggcaactgtaacacccctgcaacacacgggtaagtatgttgtgtatctgaacataccgaaacatagaaaaggtgcagtaaaaatacagcataaaaggttgaaaatggtccatctgtatagggctttttccatgaatggagtttgaaaaactggaaggtgctctgggtgagtcagtgagtgagtgctgagtgaaatgtgaaggcctaggacattaccgtacactactgtagactttataaacactatgcacttaagctacactaaattaataaaaatatttttctttcttcaataataagttaaccttagcttgctgcaccatttttactttatgaacttttaaagtttcttaactttttgactcttttgtaataacacttaaaacacaaacacattgtacaacacattgtacaaaaaagtctatatcctcttctgtgacctttttcctatttttaaggtttttaaatttttttcttacttttaaaacttttttgtcaaaattaagtcacaaacatacatattagcctaggcccacacagggccaggatcatcaatatcactgtcttctcctccacatctttttttttttttttttttttggatagagtctcactccgtcccccagactggagtccagtggcgcaatcttggctcactgcaacctctgcctcccaggttcaagcaattctcctgcctcagcctcctgagtagctgggattacaggtgcacgccaccatgcctgtctgatttttgtatttttagtacagacggcgtttcctcatgttggccaggctggtctccagctcctgatgtcaagtgatctgcccgtcttggcctcccaaagtgctgcaatcacaggcttgagccactacatctggcctcccctacatcttttcccactggaaggtcttcaagggcaattatatgcatgaagttgtcatctcctaggacaacaatgccatcttctggaacacctctggaaggatctgcctgaggctgttttacaggtaactttttaatatataagcagaaggaatatgctctaaaataacaataaaaattatagtatagtccaggggtatccaatgttttggcttccctgggtatactggaagaagaacaaaattgtcttgggtcacatataaaatacactaacactaacaatagctgatgagctaaaaaaaagaaaaaaagaaaaaaagaaaataaaaaggtccgtgcataaaactcatgttttaaaaaagtttacgaatttttgttgggccgcattcaaagccgtcctgggctgcatgcagcccgcagattggaccagcttggtatagtcaatacataaaccagtgacacaatcgctccttgtcattctcaactgttctgtattggacatacctgtatgtgctgggcttttatccgactggaagcacagtaggtttgccgacactaacatcaccacaggcagtgagtaatgccttgtgctatgacctcgtgatgaccaaaacattgttatgcggcacatgactatttctaagctcactagggcccctcgtgtcacacaacaggcatttgagagcctcagtctaacttctcacaagcaatctgcagcttctcaccaatgaagaaacaaaggcagccagggcacaacctttcatttccccaaggctgtgagaaagaggtggtataaacacaagtcttgtgtccccaaaagaagaatttattccttcttacattttggaaatattgatattttaaaaaaattactctgtgtgattttaggaatgtgagctgggctctgggaggcctgagtttaaactccgtctcttactcgctgtgttaacctctctgcatctcagtttccttctctgtaagacaagatgacgtcacaagacgcttcatatccctgcgcctcaaagaaaggcagtcatcacgcaatactgacttaatgggcccttcatcattttttggggataagaggtccaagacacatcttttgtgggaagatgagttttcccagtgatgctaagacactgggggatgggggtggaggtcaggttgggggtgggtttggggtagggaggtggaggcacacattaaaaaaaattgccaaaccaaatttattgctgatctcattttctcagcatttcttctacattcatcaaatattttagccactgccttttcatttcattttcctccagttgcacgtgctttgcttttgatgtggcacacactttgaaaatacattattaaacagatgagcctgtcacccctggagctggcactctgtcccctgcttattcttaacaaatctctctttgtgttcttttgtgctgaagtgattaatcatttccactatccaagggctgctgacaatctttctagatggctccgctgccatgacccctccccgcatccacacagtttgaaacatgctaggaatctgctgctgttcccggggctttattcccatcacagtgggctcctcatccatacggtaactagccaacctccaaaagagctccgcttttatttcttgcctttttccagagttcggggtgggggtgtgcgtgaaggggctcctggcgacttcagcaggaaaacaaggaaactgtaagttaaaaagtcagaatgataaatgcttattttgtagaccagacaggaggtttttatctcactgtctggacagaacctgctgcacctcatttttctgggcagtatcctcctcttcactgcactgtggctgggttttcttctccccttcatgctttccctctggttatctgtaacaaagttttcaaatggctccatattgaaagcccaggctttgactcaccaggctctcaatctgtaatctggtttccagagctgcagcctaggtaggttttgggaagttgatctttttttaataagtgtttacaaacatttttaaactaactttaaaggtactattttaaaagcctatccttccccaaccccccgcccgccccaagcatgcactgttaaactgaattcaaaaacatgttcaaagaactgaccaaaaataccattaggtcacaagttactgccagagaagggaaagctacaatgattcagaaagtattaataaatgtgcagaaataagtattctgataatgttaaggtaattagcatagaatcccagggtgatttttaaaaataatatgtactttacatgtagaaataaatctatatttgagactattgaaaagatatttacaagcacttgaggaatagttttaaattaatacattataagtgtaaaataagcatgctgatcatatgattttaactaggtttcagaaatgtaattactgttcatagaaagatacttaaaaaaatgagtagtcatatgttctttgcagtgctattcacagtagcaaagacatggaatcagtctccatgcccttcaacagtggactggagaaagaaaacgtggcacgtgtacaccatggaatactacgcagccacacaaaagaatgaaattctgtcccttgcggcaacgtggatggagctggaggccattatccttagtgaattaatgcaggaacagaaaataaaataccaggttctcactcataagtaggtgctagacactgactacacagagacatcaggatgggagcgatagacaccggggactaccaaacggcaggggctgaaaaaccaccgatcggatatacccaggctcactacctagatgaggggatcacttgtaccccaaacctcagcatcatgcaatatacccatgtaacaaacatgccatgtaccccccaatctaaaataagattaaaattattaaaaaagaatataaaatccttttttttttttgagatggagtttcactcttgttgcccaggctggagtgcagtggtgcgatctcggctcgccgcaacctccacatccagggttcaagtgattctcctgcctcagcctccccagtagctgggattacaggcatgcaccaccatgcccagctaattttgtgtgtttagtagagacagggtttctccatgttggtcaggctggtcttaaactcccaacctcaggtgatccacctgccttggcctcccaaagtgctgggattacaggtgtgagccacagcacccagcccaaaatccttaatatttttaattccacagaaccacagatctctaattgtttgaagtcacaataaaaaaggcactaaaataaaaacttactaaccaaaaactgcaataataaagaatgaactgcccataggatataacttttataactttctaaggaatccaggggagagagaaatacacacacttgcatacataggtgtaccttattagtgtgtgtatgggagttatgataaataaaatatatcagctagtgctagcatatgataattcctttcaaacctagtatctggagacacatgaagaggtccacctaccctgagctgtcatcagaaactgaagctgcttaggaacgtagtgctggcagagggagggtctctagagtgtggaggtgctgcacacggcacttttctagaatttctgaggtacaagtgggcccaggaatggagttctgggccaatgaaataatggctcatgttcaaaaaacagttaatttaggagtctaaacaaccccagcggtgggttagcgattgtgaaattatgggctgtgtggactgcttccaaaatcagaacaaaacaacatgcaaataaatatgggagcatgctggaagagttctggaaataggtctgagttccaaccctgcattttcccaatacttacattccactgaatccaatgagcataaaaacaaagaatggcacatccacacatcagatttatcagaacgtataaaacgatggataaatgcaatggcaaaggagaaattaggtttctgaggttttttaggttataatgaactaaatgattacaagactataaaaaggtaattatgtcttatttaaaatatatgattattatctagatagatgttctaatttttcaaggcttatattgctttcatcctcaaatgatcattttctaccttagaaattattttctaagatctgtgtgtgtacaatagtaatttgcagcaaatcagtgtaatttcacaacccttaatttgaaaaaataacagaggacactgtatgtgattttcatgataataaatacaaatttaaaatgtatgtttcgagttgatcactttggatagatgtgttttaattgttccaagaactgctttacacagagcatattagcagtggaaacagttttgacttccagcccttgattctaccagcagcaacatggtaattaaccaaattatccctgcaaatgtattagcttgatttcttcaacttgtaaaaattcattacctatcaaaatgaaaggcttagtctcatgaaagatactcaggataaaagtggcagacacaaaaagtctgagttttctgacacacactttagcaggagctgctgcactccctcctgtttctagccctcaggggttagcatgtgaattttcttctctcttgcatttgtgccaattgtacaatgtgttctaatgcttccaggtagcacaacagtcttggcagtccttggagagctcatgttttaggggatggtaccttgaaccatttgcttcaggactagaaggacaaaagggtgaagagcaagaggtcaaaatcattcattcattattcttcatccatttattcacttaaaaaatttttttttaattttttgagatggagtctcactctcttacccaggctgcagtgcagtggtgtgatttcggcttactacaacctctgcctcccaggttcaggtgactctcatgcctcagcctcctgagtagctgggattacagtcccccgccaccatgcccagctaatttttgtatttttagtagtgacggggtttcaccatgttggccaggctggtctcgacctcctgaccacaggtgatccacctgcctcggcctcccaaatgctgggattacaggcgtgagccaccccatctggccatttattcactttttattaaacatcaactaagtgccggtcatcgtgctcacccctggaggtagataacaacagcccaggagaaaataagaaagaccattacatattaagtattgtaataagaataaagtgtaactggcagacatggaagaggaacctctaactcagactttgggaatcacaaaggcttcctggagggagtgacatctctagtgaggcttggaagatatgcaggagtcggtcagctaaatgtgtggtcaggggtaggcagagcatgtgccggggtggggaagagcatgagttgcgcccagaggtgatggtgagagcagtggttacgcctgcagaagtgcagcatggagtgtgaggggcaacgtggtgaaagatgagtctggaagcatacgcacggccacagcatgtgcgactctgcaaaccacgtctgggggtctctggcctgactctatcctgaactcaggggagagccacgaacaggtttccagcaaacctatgctttggaaagtggattctgcctccattgtggagactagtgggaggcagagggctggcaagcaggtctctggagtcatgtaggaaaaggatggtggatgaacaaggagatagctggaggtaaagagaagtggacccaccggagggagacagagctgacaggcttggtgaggaactgaacatggtgagtgtgagggagaagaagaacccaacagcatggacagccggggaatgaagataatccaagctgcaggaaaagccggcagaggtgtgagatgagttaaggtgcaggtgtccatgacacatctaagtggagcaatctggtggccgctgggcaggtgacagaagttcaggaaacagagctgtgtttgagacacacttgagacccatccccacacagatgttaccagacaccatggaagtacagcatctaagtagagaagagtcaggatgggaccctgaggaacaccaacatcaagggggacttacaggaagacaggtccacgtaggagacccaggagaaaggaccacaaagtgggtgaacccaggagggtgtgacagagacaccaagggcatgagcattttcacgtggatcctgcagtcagcaacatcaaatgcctgccagagatcacatggggaaatgctctctgtacttctgataagcaagcctggggtggtaacctcagtaaaagccatttcaggaaggaaggtggtgggagagatggcagttggttgaaggggaaatgaaagtgaagacacagagagactttggtctggagagtctagttaggaaggaagaaagagctgcaagcaatgtagcactgaagatatatatatatatatgtatatatatacacacacatacatatatacacatatatatatgtacacacacatacgatggaaagaatctgtatgtgtttactgagaatgagatgccagcagagaggcagaggttagaagagggcagagagaggaggtgctcactcctgtgctggcttcagtagtgcctgtttcactcacccttgtacccccagcgccgagaacagagcctggaacagtgactgtctgatgccactggcccaggggtgctcattggatggcatccatctctctggggacagagaaggtgaagcgtctgcggagggtgacgaggacagtgacaaggaggtgctggtgtcacaggtgtgcagcaagcagggatggtctaagccaggcattcccaatgggcaccttacaaaattggttcttggggatgagaaaaccttactctgtgtataaagcacagactcacataccatgtacaaacagacatgcggtatctctgtggtattagaatttcatttgggaacaattgggagaaaagtgtcttaaaggttcctgagggggttgataaagtcaatggtaaaatgactgaaggatactcttcaagtcagtaatgctggtgaacattgcattgatggtgagctccagcggggaataagttacccttcaaggaagagagcatagtttggttactgtgatcctgccctggcagtgagatccagcataaagcagacgtcgcaaccggctggctgcctggaggggtccgcgatccagacctccagcactggctgctggagagaagcagcctggactccaacctgtcagtcctggagcaagtcaggagcagtgcagaccagaaagtggacaagcaaggcagcaagcacgaacgtgtagcgagctagcagagaccgccacgagacggacccacttccaaagggggccatgactcagtataacgatcccagccacaggctgaaaccagcaaggcttttggggagaaacactgtagtgcccttagggaatttgatggaggcagtaatgggactgaaaggtctttggtggcttacactcgaggacctgtttgcaagaaccagctgcctgatggaattcctaggtcagagtgaaaagttaaaaatgttgggtagagctgaagttcacagagcccttcatgctagggattttatggcacaagaattacacacacacatcacacacgtacacacattcacattccaaaaatacttttagtagaatcttatttgccttcatattttaagtactaatatcacttcagcagatattttggtgtctctacactaagtcctcacttaatgtcatcaatagggtctttgaaactgaggcttctaagtgaaatgctatataataaaaccagttttaccataggctaattttgatataaacaagagttaagttcctacagcacatttctgatcacaaaaacatcaccgaacttctccataaggtccaaacacttttaatattaaacactgaaaaaatgtgagctatgcatacattaagaaagattaataaaaccagaaaaataccattcaggacataggcatgggcaaagacttcatgactaaaacaccaaaagcaattgtaacaaaagccaaaattgacaaatgggatctaattaaactaaaaagcttctgcacagcaaaagaaactatcatcagagtgaacaggcaacctacaaaatgggagaaaatttttgcaagctacccatctgacaaaggtctaacatccagaatctacaaggaactgaaacgtatttacaagaaaaaaacaaccccatcaaaaagtgggcgaaggatatgaacagacacttctcaaaagaagacatttatgcagccaacaaacatatgaaaaaaagctcatcatcactggtcattagagaaatgcaaatcaaaactacaatgtgatatcatcttaggccagttagaatggagatcattaaaaagtcaggcaacagacgctggcaaggctgtggagaaagaggaatgcttttacactgttgctgggagtataaattatttcaaccattgtggaagacattgtggcgattcctcaaggatctagaaccagaaataccatttgacccagcaatcccattacagggtatatactcaaaggattataaatcactctactataaggacacatgcacaagtatgtttactgcagcactatttacaatagcaaagacttggaaccaacccaaatgctcatcaatgatagactggataaagaaaatgtggcatatatacaccatggaatactatgcagccataaaaaggatgagttcatgtcctttgcagggacatagatgaagccaccattctcagcaaactaacacaagaacagaaaaccaaacactgcatgttctcacttataagtgggagttgaacaatgagaacacatggacacaaggaggggaacatcacacaccagggcctatcagagggtggagggcaagggagggagagcattaggacaaatacctagtgcatgcagggctcaaaacctagatgaccagttgattggtgcagcaaaccaacatggtacatgcatacctatgtaacaaacctgcacattctgcacatgtatcccagagcttaaagtaaaaaaaaaataaaaataaaaataaaaaaacaagaaaccaagtaagataattacttacaccattctaggtgaatcagtgagtgactgcagttgcagtggtggtggtttccatcaaagaataaatgtctgcaaagcaaaaattgtaaggagcacctcctcctgccacgaagtttaaagataatcacgggccaggcccggtggctcatgcctgtaatcccagcactttgggaggccgagacaggtggatcatgtgaggtcaggagttcaagaacagcctggccaacatggtgaaaacccttctgtactaaaaatacaaaaattagctgggtgtggtggcgggtgactgtaacccagctactcgggaggctgaggcaggagaattgcttgaaccaaggaggccgagattgtgccactgtacaccagcctgggtgacagagtgagactttgtctcaaaaaagacaaaaacaaaaacaaaaacaaaataaaacaaagacaatcacaacaggacctgctcacctagtgctttcataccatgctgtttattgttgtgcatctgtatgactattgtagacttgaagatttgtatgttagaatcatttctattcattcattcattttcaggccacttatcctagttcagtggggtgggtggctggagaaaggcaggcaccagccctggccaggatgccagacagcccctggcaaggcacgctcacacacacccacactcactgacactaggactgtgaagacatgccagtgaacctaaagggcacatctttgggatgtgagaggaaactggagtcccagagaaaacccgcacagacttggggacaatgtacaggctccacacatggtggccccggatgggaattgggtttttttctcatcaaccttataacaaaacaaagttgaatgaaatgatgttatttgagcatctgctgtatgcttcttaattagcattctaaaaatccttttaaatgccttaaaatacaataactataaaagtaatcttcagttctcatctccagtaagttttcaaagtctgatgaatacgtatggtgatattaagtatgggaacaagaaagaaaaaataaaattgcattggttctcttaaataaagttaacaaatgacataaaccaggttagctggctagtactgaacactagcatttcactgtcggagaagaacactcaaatgaaacccagattgaaaataagttaagtgtttggggaatttacacatttgaaggtactgatagatactatgatttgacatgtattaaccttttcaactctgtacaattaaaaaacactgcaatcgaaaacctcattcatggataaagataagaatttgcacttattgttctatgtgattcacatttaagcccttattttttgaaaatgctcactaaaatataaagaagaaaaaactataaagatgttatgaaaatgtgaacggactatatggatgacaatgtgtagtccaatggcccacacacatacgaggccagtaaggttgttatctctcagctccaatcccacccttctaccctcttgttttgtgttgctggggctggactctctgcaaaccacctttcaaggacatactgctgttgaaagaagcacacctctatttgttttctcctctgcattcctcctgtaactcactaatcccacccgctcagtgccttctgcatgtggcagctgttcaaaggtactgagtacatctacatttgacgtacttgcgtcagtcctctagtgtagtgctgaagttctccaagtatctccaagaaactatgaaacctttgcataaaatattgacaaacgccccgtgaaaagatattgactgcagtatcagaacccgctttttactgttagggcagaagttataatctcacagacttttagatgcttgggctgctaacatgcccttcatcttctaggcatatggttctgcaaacaactttgtgatttctaatgacgtgcatcaaaatgaaacaggtaagtatcaaagggcgaagctgttcattctcaacaggagcttctggacttccagtattcctttacccatcaccccaaagcctccgggctcagaacagattctgaattaaggtggtctcttgtcccacctctgctagaaaatgaacacctccagagtcactgccaagtccacagattgtagtcacagggccctgcaacatagtggcaagctgttggccacagcttgcaggcaccagggtgcccttagcaggtagaagtggagccctttaggaagggcttttggtttcaccccaaaggattagcataatagcatttatgaacaattaatctcacagatataaaatgagatataaaagtgtggtatttctgtccctaaccgttcagatggctaaatgcaaaacgaaaacacaggactaccaagtcaactaacttatcttggctagacttattgtaggtttttctcagtgaatttctctagccctccatcgggctgacttttgttttgagtttattttgctacagcaagtaatgggatatattaatggcgcacctctacagttacacctggattgattttgccattggtgggcttcatttcatcactaatgatgaaatctttgctcttggaaacaaatgaaataacttataaaggaaacagtatgagctagaaaaaaaagcctgcctggtctgaagcagggaagatttgacctaggtccagctctgcaaatgacccaaataggtcactgaaaacaagttatctctttgttctctaccttccagtaggcagagaatggcaagtatgttttcatttgattgacatttgtgagcacaaggcttctcttgtcccaccatccggggtctgtacatgtgaggggctatcatgatgtgcatttcccaagtcagtgccctcaactcacaaatctcccaggaccacaactggaaatcatcccatccaggatgctcctgagtttctggaaaaccaaggaaaaaatgagttccctttatttgcctcaagtttgttccactataatgtcaggaaactggctgaggtctccaaaatttaaacaagtactacttacccccttcagataaacagaaaatgcaactctatgtaaatattccttaagaatattttgcagcacactggaattaaattagtgctaaagatgatgagagcaagaaagtaatctgctcagatgttacactgaaattgtctctaaattcattccttaagtccaaaccagaatctcaaacactgatctcttattacaaaggcactctatgttatgagtgtcttcaacaaatgccatgtaaagctgtcttgcataaaaactgtacatcctagattccagcccagcacccccacccattaagttataaaccaattttatttgctgaacaaatgttaatgccattctacgttaatggataatgctatgaaaagcacctaagtattacagcactggaacatttaaggataaaatagagtgtaacttggaaaactgcctgttacaaacatatgtcagccatgaagccttctagccctgatcgcccatcctcacagaactctgttttaatttctccctcagttaagagaattttgcaataacacacagatttattaggtcccaggaataaaactctcggagtaaggataaaaaataattatatgttagaacacaacgtaatattcaaatgacttgaaaacagtcacctcagcaaaaataaggagagaggaagaagttaaagatgaggttgataacactggctataaaacctctgaatttaagtgcataaatgcatgatctggcacttccgaatcataaacaggtagaaacgggaaacctcccattcacaatgaattgcctgactggtttcgttaatgagccagggggacgtcttcatctagtaagtcagtacaatgttaagagaggttgctgtgcaaggcgtcttcattagaatcccagctctaccacttgctagctgtgtgaccttgggcaagttgtgtttaacttctcttcacttcagtttcctcatctgtaaaatgggaatgttaccaatgcctacctcatgaagcagctgtgagggttaaatcacagcttagaactgtgcctcacacataatgcatcctcagtcaacgtcagctcttcatcacttggtggttgttattgtatgagggacgtattgcaattggaaagggagctgaagggaagttacagcctttcctcccaagaagtctctaaattcactgactgcattttctgttttctcgagtttggcttctgccccctctactccaccaaaagggcacttgcaaaggtcaccagcaacgtttctgtggtctaatccattgtgtggttttagatcctcatctttctcgtcctctcagaaactctgaacaccactgagcttgaatctcattccttggattccatgacttttcactgtcataattttcccttcacttttcttgtcactctctctcacttccacttgccagcggctattccttcccttagtctctaaaagtcagaatttagattctcaatgttcctcggtctccagtctctctccagaaaaatttacctatttctacggtgttattaccaatggcatgctaattaatccaaaatgttggtccaacacctcagacctctgctctgacctcctgacctccaatatgttgttctatgttctctgtgtttacttgaatgtcccaaaggcacgccaaactcaccatgctcaaaaatgaatttatgatttccgcccttcccgcaaaccaggatcttccctaatgtttcccatggccgtaagcgcaccaccaagcatctctgggctggactcctgcaatagcctcccactccctcttgcttctccttttcccggtggatccctctccatagcagccagagtggtgcatttaaactgctaatgtgatcacatcactctgctcaaatgctcagctgatccgcatcttataggatctacgacctagctctgtctgcctctcctgcttagctttatctacctgctcaccaactattctgcctttccctctccttggagccacaatcttggaggaagcctggtgtgtcacagatacacaataaatactatgggcggtaaccaagagtcctggtgcttgcgtttggaggtgaagaggggtagaggatcttggagaatgactaatgtcagtgaggcaggcatagacagaaagccattccaggaaacactgggaacactaatgcgatcccctaggagctccccaaataccaactactactactaacgccttaggctgacaagtagggagagagagtaaaaagctccaggctcaactagcgccaccatcatctctctttcctcctcgtccatcccacctcccctcctgactgctgctcataggctaggaagagtggaatttggagctcagttgcctcctaatccagccaccacctccactgccctctcgcacacacatgcagacttcagccttgcatatggacacaaatctgtgatccggtgggtccacgttctctctttgtttcaggcctcatccaaagagtgttgtggcacaggtgcagcactggcggtgggagggaggggaggactggggcgagaggggcatgaggctctcatcagctctctttagaaaacaataactataaagctgaatgagcttttgattgtgacactcagttttattcaaattgaattttgctttacctaaactctatccttttggtgtgtgaattactcaagtctttattcaaacttcaagccttgtatggagaacagaataggaaggtcaaaggatggatttcttccatatcctcagaagggccaagagagaataagaaggtagactttttctacttagggaaaccaaagaggggattggtgtgttctagtattatccttttgtggacataaacactataaccagttaaaggaagatggcttaaaaatggaatatgtgaactgcaaatatgaaagtatgttgaaagagaaaaataggaaaagttatatcagcatcttaggttgattgttctttaactggaaacaaagccccagaatagagacaatatagatataaaatatactatgtattttatttaacatatacttatataccagaaatgaagctgcctgttttgacaattgctttctctataaatctctgccagaaaaaaaatcattatgaattcaacaaatcacatctcaattagttattctggtcaacttgagacttagatttatttatgaaataatgctttccagaaagaaaaacatctggccttttaaaatagttgttaatgtaaaattttaacccaagtaattgtattactgtaactcactagcaattaaaaaaaagtgtgtaggatatccaaaagaaaggaccatattaaattaaaataaagtgtttttttttttacagtaaaattcataccatctggcctaatttgtcttggtgttttgcccagtgtagtatcagctttttgagaactataaattattaggtaactcccctgaaaaaatatgagtgaagaaaaaatatgggttgatgacgacatcctgattatatgtctgaatatttgggaaaacactgatgtggtggaacagcccaacctaagtcaatctgggcacgaaactggttcagggagggaacccacactagacacaacggtgatgaaaaggacgggctcacagagggtgacagggaaaataacatgtgaaacaatagagaaataacagttccagatcctgaacattacctctttgtcaagtgcttctgattccaattaagtttacaggaaaaataaccaggcaacccctgcctgactcaaaaaaatgtacagactattaaaggatgcttttaaatagcagggtgataaatggggcatccacatgtgagcaccagcatatttttcatctaaattctgttcttctgtcttccagctgatcactttaatagggtgtcacctcagcctgtgcagaggtgcccagagggggtgcagctcctagattgttaacagaagtgttgtttcaaaaacttatgtgactactctcagaaaaggtaaatgtcaaaccacagactatgggctcctttatcatggagccgcaggtttcctttctatttagagtctatgtcccacagattgataagactgtttaaagaataatcttacccggattatttcttcaacacagctgttggtttctccagatctactctcctgaaagcaaagaaaaaaaaattaagcctgatggaatagattgatgaccacacagaagacatgcaaggttccaaattagtcccccccaacaaaaaaattcagcgagttacaggttgaggggatgcctgacctgggactggcagacaggctcctttccctaacagccggctcccattgtggctgctgctcccccttctctggctggagcaccacacacgcaccccagaggctcaactgtggcccctccaaccaccctactttaagtggggtgggctcctaggggtacagaacgtgacctgcaggtatgagctccatccaccttgggtgccattaacgtgtggaaactgtggcctccgctacaacagtggatccaatttatccaccaaatatatgccgtgggcctaccaagtaccacaatggttgctacggcttaagtaaaagtctggtagttccaccgtcctcaaagccttggtttactggtttgataggcagaaaactgaaagaccaaaaagagaaacatcctctggatgttggactggcatgtggggcgtcacgctcaagtcacttgttctgtcactcagcctgccctgtgctgtgcagatgttccgaggtgcagtggcttcaggtcacagccgactctggggagcattttaagttccagagatgctgtgtgggtcctgctggctacacagccaagagtgcaggatgtgggtttgtggggacacagaagcagtggacgctggtgaaagtgcctacctgtggtctcagggagatcacttctcttcgtcctgcaattcaaggatgtcaacctgagagtagatgtcactgtgacatcctggaatgaggcttttctccacagtctcttctccaaggccactctcccttcctcctcactgttctctctctaccaagaatgctatctgcacctttcctggtttttctagttaatttcctagttaattcctagttaagtcatccttcgaacagcagcttatccacagcttcctccgagcagccaccctgaccctagagtgcttgcccccagcagcctccacttcttcaaagccctcaccacgacggcaattcaatagtgaagtctccagcaatatctcctccctctaaaacatcagctccctggattccagggctccctgtcttccagcaccgtgctccacacagcatggggcacccccaataactattggctggtggtaggtgtatgaataaatgaatgagtttacttcctgcagttctgaggggcatgaggctcatcagaatcagcactaggactttaaaaaatattatgaaggctctaccagtgaccgttccatcacactctccatgccctgtgtctgccagctcattccttgtcctggggtagagcatttcctttgaaacactctacccttcacttgagttaggcgccaggctgaaggaaggtatgtgaggcttgaaaaggtcacacacatgattgagaccttctcctacccagaattaggggatttatccaagtctcccacctgaggcccagaaagtttacacaacttgccgaaggccacacagagttaccatatggtaatctctgttttaacttttttttttgagaccgagtttcgctcttgttgcccaggctggagtgcaatggcgcgaccttggattactgcaacctctacctcctgggttcaggcgattcttctgcctcagcctctcgagtagctgggattacaggctcccaccaccatgcccagctaatttttgtatttttagtagagatggggtttcaccatcttggccaggctggtctcaaactcctgacttcaggtgatcccctcgcctcggcctcccaaagtgctgggattacaggcatgagccaccgtgcctggcctgttttaactttttgaggaactgtcaaattgttttccacattggctgtaccattttacattcccaccatcaatgcatgaggattctaatttctccacattttcaccaatacttgctattttactctactttataatagctatcctagtggataagaaatgatgtctcattgtggctttgatctgcattttcttttttttctttctttcttttttttttttgagacggagcctcgctctgtcacccaggctggagtgcagtggcgcgatattggctcactgcaagctccgcctcccaggttcaagtgattctctggcctcagtcacccgagtagctgaaactacaggcatgtatcaccatgcccggctaatttttttatttttagtagagttggggtttcactatgttagccaggctggtcttgaactcctgaccttgtgatctgtccgcctcagcctcccaaagtgctgggattacaggcgtgagccaccagatctgcattttcttaatgactaatgatgctgagcatcttgtgtttactgaacatttgtttatcttctttggagaaatgtttattcaagcactttgcccatgttgtaattgggttgcctttttattgttttattataggagtgctttgtatattctggatatcagaagactcttagcagatatatgatttacaaatattttgttccattctttgggttgttttttcacgctcttggtagtgttcatggatgcacaaaactttaattttgatgaagtccaatttacccgtttttttcttctgctgtttgagcttttgagtatcatatctaagaaaccattgctaaattcaagccatgaaaatttccctttatgtttgttttctttcaagagttttacagacagttttagctcttttgtataggtctttgatacaatcgtctgggaacttttaggtgaagtttattttcttgtggattatttggtgaattttcgttaaaacaggaatgttatctttttgcttcattctagtctcatcattaaaagaccaacaacaaaatgtgcaaggcacagccactgctactagtagtgcatgaagacaacatgcactacttggcttatccttataagccaagaaaaatagtgttcaatatcatgacaccaatgctttcactaatacttcacaccctttcctatactcatccttccttctgttttcccaaaagcttcagttggccacatacttattacaagctttcactcccattcccaattccttaccacaggactgctctggaaacatcaccattctgacactctgatacaactggatcagagagctcttttggaacctgatccttttccagggaagcctgaggtgaccatcacaaaggttatataggaaagtctcagtcgggccggggggcttgatggtcacttggaaggatttcctttggcgttcatggtgggaatgagtggtctgaattagaaaatgtaccgtcaaacctacagaatatcattaatcatgactcttatcctacttctaagtcccaaccatttcctactgcataatatgctggcagggcaaatgctgaattctcaatgtgctttctgttttctaccacaaaacaattaatcaagaaaaacttgacctcaggtcctcctggtggaatcacccagatataacagcacactacaaatactcttaaaattaaacttcgggtttaattccttaaagctaagcttccctgaatatcacactttaatttcctttgatgtagtttatataaatgacaggttgcttttataactatctcccttataatcctatacatttcaactattctactctgataaggaaatgcgctgagagagaaatgcaggatagatgccctattagatacttctctcatcactggagacatagatgtaggatctttacactaagtcatctctaaggcagctccaaccagaagccttgatggtctggacagacatcaggtcattccctactaggaaggccctttgtaaagctaaggaggcggcagaggtgaggccagggtgagggacttctaacaacagtctcaggaagtcctggccttaaattacagcatggacagtctttggcagaggaacctcttgagtcttttcagaacactgagaaatgttctggggactcaagaagagtaccacattggtttgaatctccaggaccccatttagattggagtgaatccatgggccacagtatcgtagaaaatctgaatgggaaagaactttggagctcctttcagcccaagtcaatgactttaacagatggagatgccatggctcagagaagtgaagggctctgtccaaaaatcattctgacagcaagacacagttgaggcagaatccactcacatttcaacaccagctcattgagttctctactatctcatgctgtcttcctgcagctcaatccctagagctggctcatgctgaggtaacttgcatgctcacagtatgaaaataaaagaatgcagatagtattggggtaaatttcctcctccttttccacgtggcacattactcagcgcttgatcattgcctctcactagctaatctccaacactacacgtgtagaccaaagggggaagagaggagaggggaagtagagagaaaaagtcaaatctactaccccttctgtgacattaaaaaataaggggtaagggtttgtgtccttagaagtaggaggatggaattccaccttatcttttccaaattacagaaagcgtaggtagataggtagggttggggttgggggatctggggtacgtttaccttcttgaggtctttctcaaatctggtttcagctgcagttgtgtgcttactttgattatatttacattttgaaaactttccatgtttatcaacaagattaaaatatgcatgtaatttacatctccaaattcgtgtttatatttttcacaataaagttattgctttccttggaaaggtacccactgagaaggaaggctgcacaatgcacattttaattactctgtattttttgacggtttgtagctgttgtttcatgctgagttgctgagctgttgctccgtatttactccaactttgaggaacccacctcattttcctatcattacattttgaaatctgtcataacagtctcacctcattgaacctccaactaaacttcaattaagagctagcaaccccagctgattctcctcttctacagcactgtctagcatgtgatttccctaaatcctaccatttaaatgtacatgccgcacactgccaagaaatgtacagaactatgctgtgggtaagtgtagctcggggaatagccaggagcatcccatccctgatggtggaagtccctaattaccatgccaagcacagaatatggggagaagcagggcttaaggaaaaagagtgtgatcaaatcagtgggaaatggtatttcattgcagagatgggctgcacaagtcctcatttttgaaaatagtttaactctttatcacacacatttcaggtggaacttgcattctaaaatactactactttcaaatcacaatgcctttgtttatcttcaagcactcaaaagaccctcaagcatttagaaattgtgtatcccatgtacactcttaaacactcctgcagaaatatttttaaatcaatctattcttgatttatcacaaacctgacatacaaaaagttaggtatgctgtcaataccacaaaagcattggtgagaatctgagctcagatgcagggaccatcataattccatgggaagtccatccctacaactgtgtctcctgccttatctttaaggatagggccacctgtgaacagaggcagacagccagttctctcccaaattcagcctgtctcacacctaacctgtaccatcccctgtcaggggcttcactctgctcccaatccccaagctagaagcccagctgcctctgagcctcctctgatcctcctgtctccaccatcatctatatatgtagatgaggaaaatgcaaaggaaaaatacacaaacagccagggctttaacagagcatcaaaatgagatatgctaggaaaaaggaagagaaatataattattatagttagaagtatttaatccatccctatttttcctaacagacaaaggatacaaaagctcagcttcaatactcaattttagggtccttttaatgtattgtatcaccaagggaaaataagtcaactgtatttatatcagcttacagagtgtttatcataaatccagaaaaactgaaactcactgttattttaaaatcgttaataattatattagttgactataaactaaacagtcaaatctcaatagctcttctgtgtagcagtaaacaatttaaaaatatttaaaaatcccatccataatttaagaaaaataaataaggataacctcaacaagaaatgtttgagatttgtttttaaaacttcagagttagccaggtgtgatggtgtctgtagtctcagctactctggaggctgaggcaggagaatcacttgaacccgggaggtggaggttgcagtgagccaagagtgcaccactgcactccagcctggatgacacagtgagactccatctcaaaaacaagaacaacaacaaccaaaaagaccaaacaaaaaaaaggaaaataaaaaacttctgcgttttactgaaagatacaaaaaaagacctgaaagggactgagctagacttctcagatacctcccaattctggtatatgatataaagccaaatcaatgtacgaagaggagcaaaccacaaactacattaattttaaaaaaattattgaggcaaaattcaagtaacataaaatctaccattttaaagtaaacaattcaggggcatttcgtacattcacaatgttgtaaaccattatcacctctatttggctctgtaatatttccactgtttcaaagtaaaaccctgtaaccaatgcgtaatttctccccattccccatcaatacgagaactattttttcttttctttttttttttttttttttttgagacagagtcttgctctgtctcccaggctagagcacagtggcgccatctcggctcactgcaacctctgcctcccgggttcaagtgattctcctgcctcagcctcctgagcagttgggattacaggcatgcaccaccacaccctaatttttgtatttttagtagagatgatgtttcaccatgttggccaggctggtctcaaactcctgacctcaggtgatctgcccacctcggcctcccaaagtgctgggattacaggcatgagccagcatgcctggcttactttttacaatgattttactgtattaaaacattttacactgcactgaaaagaagaacatgagaaaatgttcatgggtaccatttgcttgtactggtagattttccagtggatgtgctgcctctcatttacgtgtttctgaccagttcctagcagagaactcagtacaacagagcaggcattcgattatatttgttgaatgaataaattaatgaccaatacactaaaaaaaaaaagactatttacaaaatgaaagtcctaaactttataagaataatgccggttatctacattacaaagaaatgtctttgctttatccaaaaactactacaacagcagcaaaccaccaatgttctaaattcttagaacatcaacatttatttacttcattaaaattaggcttatatccattaagtacagaaaccattaacaagtcatttgacttccctaattcccacattggtacctgtaaattagagagtaagtatcagtcttctattagcagacaatattgttaaagagctaataattttctgtcagatatttagcactaggacaaggtatttcaattatgttattatttttatgaacagaaattagcgatctgaatcagagcctatagttaaaagcatatttggttttcagaaagttaagtggtctgtcagtgtgctgacgatgtcaagaacctattgatggcatgaagagatgggagatgagaagcagacagtgatttcatatcctgatgactaattgatattgagtgcttatccatggggtcatgtctcaaaaaagtaccacagtactgtctactggggtcgtctttcacactgctctgtcaacactgggtgaagaaaccatgttacagggcttcccacttgcaacttgacattgataagaatactttaagatttctgtgttctttcacctaaaaccctacgtcgttaattttaccaagaagaagatcacacaggttcaggcaggagtgacaatgctgaagtcatttaatcctcacattacaggcaaacttcagtgagattttgcaaatgtaccatttcctcttgaacattttcctgaatctttattttaattaaattaattaattaatttctttattttgagacggagtcttgctctgttgcctaggctggagtgcagtggtgcgatctcagctcactgcaagctccacctcctgggttcacaccattctcctgcctcagcctcccgagtagctgggactacaggtgcccaccatcacacccggctaattttttgtatttttagtagagacggggtttcaccacgttagccaggatggtctcgatctcctgacctcgtgatccacctgcctcagcctcccaaagtgctgggattacaggcgtgagccaccatactcagcctatgtatttacttttgagacggagtttggctcttgttgcccaggctggagtgcaacggggtgatcttggctcactgcaacctccaccttccaggttcaagtgattctcctgtcccagcctcccgagtagctgggattataggcacccaccaccatgcctggttagtttttgtatttttagtagagacaaggtttcaccatgttggccaggttggtctcgaactcctgacctcaggtgatctgcccgccttggcctcccaaagtgctgggattataggcgtgagccactgcgcctggccgaacattttcctgaatctttatacaattccatttatatgatctaatattctttttttaagggatggcaggaaatgtacacgaaaacacatctgattatcacttatagtcagttttctaatcataaaattctgaacacaaaagcttgcaagacaaacagagtaatctaatgtggctgaagaaactaaccacttaaagatcctacttagcaccactctaatttgtgtcccacagtaagatggataatcaattcccttttagccatgaatggaaatgaccattgtaaatggcaaaagtgctgctgcgtatttgacgatattctatttggcacattctattaattttatttaagcattttgctaaaagagcagactcacaaatcacccttcctatgtcatgttctttatggatctttctctccattatcatctgaccttccccacggggtctcagctcttcctgaccctcagaacagggttcattctgcatactcaacatcagccatttctatgtatgctctctgaggtgatacgctagaaataaatgctgaataaataaatacagctaaaatcagccagagcacaggagagaaggcttatctgagaggtgggagcaggtagcactggaaaacatgagtgagaaactggcactttttttgttggctgctgaggaatttttcaatactccaagttttatatttttaaatcgatctacctacaacaccctattttaaatttatgaacatttatagcattttcattctttttgagacagagtttcgctcgttggccaggctggagtgcaatggcgctatcttggctcactgcaacctccgcctcctgggttccagcaattctcccgcctcagcctccagagtagctgggattacaggcacctgccaccacgcccagataatttttgtattttcaggagaaacggggtttcgccatgttggccaggctggtctcgaactcctgacctttagttcgtgcctgtaatcccagcactttgggaggctgaggtgggtgcattttcattctttattctactggtgttgctttactgttagtcttggaaaatatttgcaggatatgaagagagctattatagtggcaatctattttatcttttcccttctactcccataaaatgttcagagccttgaaaaacaaggtgcgtgtcccagtaaaaggcagagtgagtccttctgcttgtagaacttggggtatctggggctgaactcagatattaatcctcacatgtgtcccctctcgtttttcagagctggcttcagaacgtctcagcagtgactgctgaccactgaattttcacgtaaaacatcaccagataaagttagccccgggtgatcctgctcagcaactcagaagggaagggagcttcagaactgctttctatcctcattctaaagcctctgggtgggacccaaggtgaagacaatctctctgtatcttgacgcccacactattattataaaactccatggtattgtaatctaaagggagaacaaacagttgtacaaaacaaaagggtcaataagaaatagacatcagaggctgggtgcggtggctcatgcctgtaatcctggcacttcaggaggccaacgtggggggatcacctgaggtcaggagttcaagaccctgtctctactaaaattagcagggcatggtggtgtgtgccggtaatcccagctacttgggaggctgaggtgggagaatcgcttgaacttgggaggcagaggttactgtgagccaaggtcatgccactgcactccagcctgagcaacagagccagactctgcctcaaaaaaataaaaataaaaataaaataaataaatgaaatgaaaatataaaaaaagacatcacatgtaaaatatgctgagattattctggcatgattctatctggacagaatgcagatattcctgcttcaatgccacctaacactgtgtatgagatccgccacgtacagggaaaagctgcaaagaaaaccatgtgcttaggccactttttggcttcacaacctttggcttctctcaagagaatattagagtatagaattgatcataaagcaaatttctgcaccaagaatttacctttccaatggagaaaagtttgtgtttactgaatataaaataaattaattaaaaaggcttgtaatccaactaaaagacatccaagatgatgttggaacaatctaacaaaaaatgatcattttgtgataaacacccataagagcagtcaaattaagtcagtaagtataaacgaaaaattgtcatggttattttctatctaacgccatgacttaaaggcttacagaaaaataaaataaaaaatcattcagttatctctcgaatctcctctccaacataatcacgctaaggaataatatgcttaattatggacttgatttctagcactgggaaagtagatggtttttagaaactacttccattaggctaaaaaaagaggacactcggaaacctagcagtagtaaaggagtaaatgatacagactacttaatgtaacatgcaaccaaatgggggacttggaagatgtgccaggtagtctaaagagtgaatgtaagaaaagactggctactgcttaggtaaatggtgtagtgtgaaatggtacaaaatcaatggatgacagagaaaagcatgattccacttctacctcacttctgcctgcacaccataaaccatcctcaaagttacaagcagaacaaattaagagaggactcaccccagttagatggcaatagtaagagaatgttttaaccactttacatggcagccccagggaaaacagcacccatggcattggagggactggcagatacagtcacagaacaactctctaaaagaaaccacagccagaaaaagcaaatgtcctagctcttccctaagataggatcctcaaattgcagactaatttgttgctgggtcctcaaaatcaccagaggttgtgtggcgcagtaggcaggaacatggacctttgcaaacccaattctgccattagttacatatgtccctgcggtgggggcgtcatctgatttctctagaccatacgtttttcatttgtagaaccgagacagtaacagcacctacgaaatgtgagggctaaaaatgaggcaacgcatataaagcatttacaaggtgcctactacacaacagctgatcagtatataaatacgattattttattttagaattacataaaaagtattttcgtatttagaaaagaaagcaatgattactaggaggcaacaagagttcacaagaaccagatgatgttatctctaccattctcctctggtttttaaatataatgtgtttagatttctgcaagattgatttcccagtgggtagaaggaaatgatggattggttgctcatatagctggacggactggtagctaattgaacagccatgcctaaggagtattgttcaacaaatacttcattgtgcttactatgtgttcagcatgtcctatatgctaaggattcataagtgaataagacagacaaaaattcctgtcctcatggagtttatattgtaatgagatgaggcagtaaaataataaataaattataaagtatagtagaatatggaatgttatagggaaaagttagaccagggtaagggtatgggactgtgggatggggctttatgcttgtaatctgtctgttaaataagcatgctatctgacatccaaaacacagtataagccccaggctgttagcctcctcccctcttcctacttataaacctgtagtattttttccttccactatgagaacttcattactctgagtcataattgtgtgtttaatgtttacctttgtcgctaagctgaaagctccagagtctagggagaatggcaagaccaaggaagggtctcagcatttgaggaatggctgcagaaagtgtcacgggaaggagaatcaaatggaccacactggatgcctcgtgtttttaaaggacattgttattaatgggacagggttcatactcattctgggtcattccagacacgggagtttgaactaatgggggaaagtccagggactagtccagcttcccaaaagttctttttcacagttagaataatctacaaagaaagtaagcatgattgatttcatgttcaatcagaagttaaatgattaagtggaagttacttattaacctacacttctaaaatgtaagattctaactttaagactataattctggtcatttccaacaattttattaataaaacgttgaatggtaaatttctgtattttctgggttagtgtagtagtaagtctatgacttctttgttaagaaaacccatacagagaatacaaagattatttattctaaaagtaccaatctaaaattatgaaataagagtcattatagcagctaacaaattaaatggattaattgggtagagatttgagagattataattaatgataaatcaataaagtattcaacatgaaaatctattacaaccctgtttatgttatttaacttcaagcattcagttctgtatgcttctaattagcaagctataaaagatgccatccataaaaacataatgagaagaactgtttataatgataattaagattcatttgctcagagagaagggttcacacggctacaggttgcagcaaacaaagggttaagctcattattgaggaaaatactacatttaggcagcatttattagacatttaaccctatcaggcagagccttgccttagaaaatacatcataaataatgcttcttacaagacaggcaagattttccaaagtgaggtagcaactactgggagtccatgacattctgtaactttgctgggcttgactcatccaactgtgttagtaataattaaactctagctgatggcttttatgttctctttctggtttctcaagtcttccctgcattgatgttttattaaaaatatattgtgtattgtgaaggccagtggagaaaaaattttacattttccctttccgcctctgggctggagtttgccttctatagcactttgtctcatactccgagcactgtttgaggcttctcatgggcttgccagtggcaaaattgaggctcagaggtgggaaacataaacccataatacaaagaccctcactttttagatccttttgtaattctggctttagaaaaatcaaagttttcattcagcagagaagaagcttcttccccctttcacagaaactctaatatctataaagacccactcagtgaagcccaaaatgctttctagacacataattgtagcaataaaagtgtgtcttcacctcccactgtacctctgagctgatagatacaatttgttactccattgacaacctgccaacacttcacaataattagagccaatggtccttttctagatatagcataatgtaaccttcaatattaacgtttttttcccccatcagtgcaggcctaagacagaacaactctaagactagtcctagcctgaagtcacagagacctttaatgcaggtcacgggcaggacagcaatgatcaagggtaaactctaacacatgaactggtaacccagcagtcagccactgtgtggcctgctacattaaccgccctctgagccaagcaggcaccccagcggtcctcatttaaaaagaaaaaaatataagaatcttaatagagagattggggggcttatttttcatgatcatgtgcctttaaaaggaaagtcctagagtcagccctgatcaatacagcctctcctgcttcctgctttcaatctgttaagcaagaaaatgctttcatgttggcactaatcccactgtgcccccaaagaagagaaaaaaacctcccgagagactatttaatatccacacagtcggtttttagaaaaacaaaacaaaacaaaaaacccaaggaaatgaagactatcaggagaacactcccggaaaaaccctcctgaaaacatgcctgagtaaaagaaaagtcaaaagactagatagagaaatgatgtccagggagctcataatctgcctgtgcaagaattctagtttctagaaagtcactgattaataaattcatgtgctcattcatccattcacagataactgctgggcaccaatgctgtgccagtaccagggataccatagcgagcaaaacccgtagggcctacctctcagggagcttgcacattctacgggggagcaggcaaaaaacaaacataacaattttagatagtgacaagtacttgcaaacaaagtaaatagtgtgatgtaaaaaggctggtctgatcattacgattcctttcagcatgaaacttccctcatatcacaaggtataatgaggacttttagtcctttggatggaagtcctaagatgagagactatattaatcataataggtgtaaaagacaaaaatacaacaacgtaaatttcaaatgaagaagcaatatgcaatctcaatttctaccatatccccaagacccttggaagaacctatttatagctttatcgcagccattttgaaaaggtagagaaaaaaacatcacaggtttttgaaaagaaattttgcaaataacatggcagtattgcaaaatgcaaatggaaatgctgctgagccatctgctcaatattacagcaacattgggaaaaggctctgaaagaaatgatgtttgaaatcattaaaaaaataacatgtcaagtttaaaatactcaagaatcttaaaaccagcatcaacacattcagcaaccatatggccctacagcaggttaaaaaaataatcgccctgcttgcaatttctacttcaacccaatggtttctaaaacatgtttctttttcccatttgagtaccttttctttccattgaattccttggtgtttacagttacttgaattatacctggagcataatttttgtttcaccctttctgaagtagaaataagatagtaaggaagattaaaagtcacctgttcaagaaaaaggaatgtgcagatgactctatataaattgttgaacacatcttgttttaggtttattgatttctccatcctgatctcactgtctcagtaataactgctaatctcatcgagtatcgtaattttccaggcactctgctaagtgctttatagtcattatatcatttaatcaccacaaatttataaagttgatgctgttattatctacattttctagatgcgaaatttcctcaaggtcatacaggtaacatgcggcagagccagagtccaaacaactgtgggagccacgtctgtgctcttaactgctattatatgcaacaattcagtgttcagatgtttgtgctgacttctcaaggttaaaaaatgggcaacatagcaagatcccatctctgcaaaaacattgtaattttttaaattacaaaatttatgaaggcccagagaattacaaatttataatggaaatccttggtgtttcaaatgaattaaaaaagtagtttcattcaacttactagcttcacatagtagcttgtggatacagtaggaactcaatacatgattactgatagcagtattaattcacatataaaaatattacatcaaatgatctgtgtctggtgcatgtattttaaatgctaaagttccttttgtatctggatcataagaagactttttaaaattacaaataatatttaaaggtgatgattagtttagaacggacctgagggaagtcaggcagtaggaatatctgccaaacacttaagttctctaaatgtagagatataaatgaagttataaatgtaacactatctatagcaaaaaaaaaaaaaaaaaggaatagatgagcgttactgatgtgcatggcctcatgcaatggtctcagtgcagaactttatttggtcttatgaaacactttaccaaaactttcacttggcattcctctgtctgttgcttttgcctaatgatcttatctcttcactgattagcaatctcgtctgtctttagcaaccctttaaatctcatgcagccaaaagttataaataaaacaaagcaaataaacaacgtgggtaaaataaatcagtgtgataagcagttgtgaaattacaaacttattacggaaaaatccatgtaaacaaatccactaaacacatagtcattaattacagctcacaacctcccatcacttctgccttctgttctctaacgtggggtgcttggtaaatctctggtctagagtggcattttatttttgcaatccttggctgtaggtagagcttggcctcttttccactcaacaggaagtcttgaaaacaaagatgctaaggtttagagtattataactggaaatatgaaaggcattttgcaatattaccaaaaacttgaaatgaaggttaagaaatagatctgcatataatgatccatttatttttgatgaaaatgatttgtcaaaaggtaactcagtgaggaaaaggtaatggttttaaaaatggttctagaacaactggctacccatatgcaaatagatgaaccttgaaccttgccccatagcacataattaaatcgtcccaaactggatctcagacctaaatataagagccaaaatacaaaatttctagaagagtaaacatcggtgaaaatctcaatgattttggggttacgaaaatatttcctaaataagacacaaaaacacaaactacaaaaaaatcgttaaaattaaatacttttcttcttcaaaaaactgtgaaaaaatgaagatataaagggtaaagggtttcttttgggtgtgatggaaatgtttgaaaattggttgtggtgatggttgcataagtctgaatacagtaaaaactgaattgtacattttgaattagcaaatggtatgatgtgtgagttatgtcttataaagctgttacaaaaaaattaagagaatacacagtctggaagaaaatatttgcaaaacatatatttggcagaaggtttgtaaccagactttacaactcttagagctcactaagaagacaatcacctcaataaaatgagagcaaaaaaaataccttgatggagtatgtcaaaaggacagatagccaatagaaagaacttctaatggctaaagctagaacaagaaaagaattaaacaaagtagcattggattataaggtgaagtattaaaaaaattttcatgatcccatattgatataaatgaatgcccaaataaataaataggataggataaatatcttgcgcataagaattaaaataatttacgtagctactctgccctcaagaaggtggagcgtaactccccagtccttaagtctgagctgccaatggtgacttctttccaaagagtatagcatggaaggagggaaaaaggataattctggagtggagaaacctgtcaaacactgtctctgccaagtgattaaggttaatgtcaactgtgctaagtcatattgatagtatgtagacctgatatgatatgattagactggcactttgcctgtgtggtcttcctccctaaaactcataatcccagtctaaacataagaaaaacatcatacaaatccaaattgaggggtagtctataaatgtcagaccaatatgccttaaaactcaaggtcatcaaaaataagggaagtctgaaaaactgtcacagtctatggaagtctaagaagatatgacaacgaaatgtgtggtattctagatgaaattcaagagtaagaaagacattaagtaaaaactaagcaaatctgaataaaatattgactttacttaataataatgtatcaatatttgttcctttgttgtaataaatatacaatactaatataagatgttaacaatatgatttaaacaagaaccagaattttattacacaatattcaaaatgtccaagatataatccaaaattactaggcatacaaagaaccgggaaaatatgaactcacatggggagagacaacagatgccaacagtgagatcatccagatactgaagttatcaaattcattgaattgtccatttaaaattggtgaattttattacacataattatgcctccaaacaaaaggaacaaaacagcagcaaaagttttaaaaagagtacagataacattgaagcattacattagtattagtttagcttgagagtgagataaattgattcttatggactattctggaaccaaataactactattcacaccattatttcttagataaattacgttttaagtttcaaacaatcagcttacaaaaaaccttctggcgcctaatcctttcttaagtggatggccaagcatttcagaaaatgttgaactccagagaccccatttaaacccaggaacatgagacttctgattatttgggtattaaattatatataagtatgttaatgttattcatatctctcaaaggattttggagacagtttggaagaaaggattttagaaaactctctaaaatgatgactcggctgacatggggcatataggagagaactattaaactttctcccttcctctggcattgaaattactgttagaaatgaatgagttctgcttttatagagtactactcattaagttcctcggtcctttcctagaaagaaccacagagacaaatagtgttctaatttttatctttactttttactaaactatttgcataggtacataggtttcaagaagattgctcaaatgaatatttattttcttacagagaaacatctgtgaaactgatcatctttcactctaaataaataaataatcataattggtatctgtttgagagctcatttgcaaactgttcctataattgtgccactcatttacaggcacaacagagagaatcagaacataatcctgcaccctacttatttgcattaattgtgatcaattgtcacagtttgtttataagactgaataatttttaattctaaaataattatgctgattatcaaatgattctgtatgatttagtttttagaacatgtttaatacaatcattgcattctcagatgtttaactacagggctgtttatttcactgtatttgctttacgtccaagaactgagaggtttttccaagtcattctgtcaagagttcattagaaaaataaactaaagtgaatatatgctgtgctttttaggtgtaataaacattaagatataggaatgtaacattggagctcatacacacacaaatcccagcttgcagcagatcaacttcctgtgtctgatggtgaaggatcccactcatccttcaaccctactcaattcaaccttggtcctaaaaataattaatcattctcttttatattcttccaaagtactttgtgtctccattgtcacatttttccttgactacctttaagttagggaagtccttctcctcaaattgaccttaaacccatggaattcaagatctcattaatgacttttttcccctgacataaactaaagaaaaatagctggtttaccacattatactggattcctgttcagaaaataattcactcccctcctcctcccactgtggatggaatatcctcccctaccccttgagtttggttggtcaactaacttgctttgaccaatgggatggactggacatgacagcagctgaggcttaaaatgtgcttgctcagcagggctcaccagcctgaactcccaccatcatcatgaaaaggacatgccccaggtagcatatggttgaaggaggactgacttgcagatcagatctgaattcaaccttcaacatggagctgggcccaaccagttccagcctgggctggcaggcccacaacggaagcaaagtgaataaataattgctgttttggcagggcgtggtggctcatgcctgtaataccagcactttgggaggctgaggggggcggattgcttgagcccaggagttggagaccagcctgagcaatgtggcgaaaccctgtttctacaaaaaaaaaaaaaaaaaaattagctgggcatggtggcatgcacctgtagttctagctactctggagactgaggtgggaggactgcctaagcccaggaggtcgaggctgcagtgagccacaatctccccactgcactccagcccaggcaacagagtgagaccttgtcttaagaaaaaaaatgcagccacaaaaaagaacgagatcatgttctgtgcagggacatggatggggctggaggccattatccttagcaaactaacacaggaacagaaaaccaaatactgcacgttctcacttataagtgggagctaaatgatgagaacacatggacacatagaggggaaaaacagtcactggggacttttggagagtggagggtgggaggagggagaggatcaggaaaaataactaaagggtataggcttaatacctggttgatgaaataaactgtacaacaaacccccatgacacaagtttgcctgtgtaataaacctgcacttgtacccctgaacttaaaagttaaataaaaaagaaaacaaatgttgttctaagccccagaattttggtgtggtttgatcttcagtaatagctgaccgatacacctgctttataaacatggaactttattctccatgaatatggcttggttaaatcacattttggaagaactgccaaaataaagcagctccgcttctcctgtcataagcacagtgctaaattgagtttggatggctttcctctaatagaattattttacacttgcccacatcaaagctaatgtttctccttgctgcccactcagtctttcaagattttcctgtgagttatcctcagcactctggtgcactactcttcagaatagctggagctatctgcagacatgccactctaccctgccttctagaaccacatcctttttagcatggaatttctttttcttttgagagtggtctgggaaccaccggcggcacaagcatttagaactgctgttaaaattaccaattgctgggcccactccagacctactgagtcagaatccctggggtgggatccaagattttacatttttaaccagctccctaggaaattcttatattacaaccaggtttgcgaaaccctgatttatgaatatgctaactaaccagatcctaagccaatacctaatcctagaggatttcgatgattatccaccatcatctagaaatgcatttgtttattcctaatttttgttttctatgtgttcattttctgtctacttcaacacgttttcttctcttcatttttcatcacatgaaaggtcaattttttaaaaaagtactcttggtacagaatattttcaaagcctttgtctgaacaagagaagaagttgcaaaattctgagcaagcaccaggaaaaatcatctttgatcagttggttgtaacctacaacatgctacagaagggccagacgaaaccgggagcttaggcctgggggtgatcagccaggaacacccagtcctagcagaccaggctcctagaactttcagccaataaagcttatggtcgccccccgcaaaaaaggataacctaaataagttatttcagtggttattctttactaagaaatgcatatattctctcaaaaatgtgatacttgggttagtcaggtattttccatatagaaaccacactctccgttcctcaaagtgttgtccttgcacttttaactttttaaacttattaacaaatttttatattaaaatatttaattgtggctgggcacagtggcttacacctgaaatctcagcactctgggaggctgaggcgggaggatcacctgaggtcaggaattaaagaccagcctggtcaacatggtgaaaccctgtctctactaaaaatacaaaaattagcagctgggcatggtgctcatgcctgtaatcccagcactctgggaggccgaggtgggcagatcacgaggtcaggagattgagaccatcctggctaacatggtgaaaccccgtctctactaaaaatacaaaaaaactagccaggggtggtggcgggtgcctgtagccccagctacttaggaggctgaggcaggagaatagggtgaacctgggaggcagagcttgcagtgagccgagatggtgccactgcactccagccagggcgacagagtgagactctgtctcaaaaaacaaaaaacaaacaaaaaaattagccaggcgtggtggtgtgcgcctgtaatcctagctactcaggaggctgaggtaggagaatggcttgaacccaggaggtagaggttacagtaagctgagaccacatcattgcctagcctgggcaacaagagtaaaactccgtctcaagaaaaaaaaaaaaattaaattgacagataaaagtagtgtatataattcaaggtatacaatgtgatcacctgacatatgtatatattgtgtaaagatgatcacaataaaattaacgtgtctgtcactacccatagttatcatgttctgtgagtttgtatacatgtacagttaagacacttaaaatctgctctctcatcaaatttcaagtaagcagtgcagcattatgaatagtcaccatgctgtacactaggtccccagaacgtatccatcttataactgaaagtttgtacccttaaccaacagctccccctttgaatttagtgattctctcctttgtggagagaatcagagggcttcagatggaagtgactcacaaatccaaattctttaggtttcttatggaaagaaatcatactggtaacagaccagattttcagcaatgttgccagttaaatgatgggttttggtcaacagctccaaaattgatgttgccactgactctgtttcatgtgcagcttccaacattgccaattcaaaagatatgttgatcctttcaatgtaagaactcatgcaaacttacatgtaggctctttctatggtaatacgatatggggagtagagaagtggccaagaacaagggctttagagccaaactacctggatttgatcctggtcactctctgtgtttcagtttcccccactacataaatgagggtaataacctaccacacagacctgtgtataagatgggttatacacttaaaataaatggttaaataatgtctcatgcactagaagaggccaagacttgaaagttgttatcattcttctgaaattctggagtgtattcttggcactgttataaagctttggttgagctgctctgtacttaaccacttcctctttttgttttcttatcttgaaacgcatcatacataacaaaagaatggacataattaatgtatatgtaccttgtagagaataacagtaaaataaatatttgtgtacccaaacagcgtaaggtacaaagttataacaataaatgtccagagccactgtgctcttcaattatctcatcaaacccccttcaccatcctaattggtgtttttgtcattcttttgcttttctttatagttttactatatatttgttcatcactatttttaaagaaactttgcaagttgctcaaaaattctcttatggcctattttcttgtttacactccccatctgccaccttttttaggcttccctgctctcctcaaccagggaactgctgcagatttagaaagatgttttagtctccacattggccaaactgcttttcttcactgattagtttttgaagtcttcccccacacttcccccacccttccccaagacctcatcattgtgatcctgggtagctaatgataaatgattttaaagtttccaggttttcttttaatatctatacttcctattttttttcctaaaagctgaattttactgcattttctcttaaatctgtcaaaacacggggtagagttctctggttttgctgaattcactggaatggtccagcttccggccagggactgtcctctgcagcacactatttcatccatagataatgtccggggtgttttctacttactggggccaaaatgtgctgaactttttgggttctgagtttcatgtttcagaaacaatcatatgacctacgtacatgccttactccagccaagaggacttttctcaaaccctggatcactaaaattccattttcacagccttatctaatttttcaggtgcatttacagataatgccccacatcactaggtctggcccagtgccccacggtgtggtcctgatgttggcccaaattactgaggaaagggaatttccacattcctagcttgttcctttatgctcttcatcctgtgtaagaaccagtgtaaaacaatattttacaaacataaaagggacctttgaaacttatttgatgtgttagcctgccaaaggcaaagtcatcacgaagtggaccgaatgaggttgtggttaaacttcctcaattttctcttctaaattaaaatctagtgccagacaccaaaaggtttcctcttcctgtccctcttttattaagtagttacaatggcaattaaaaagacccctttggtcattccacactactctctactccaaccacttcctataatctaatgatgctatcttggcaaactaatattataaagattttttattaaaataaataggttttagaagaaacactcaatcaagtatctcagtggatgtgtttcctgcaaaggcaatggcagcacagaaattaaaaactaattcatccttctagacagctgcccaccttgctcaataaagactctactattcattccttatggccattgatttttgcaagtaataacagaggttgagaagaaaagcgtaagcttttttacagatggatgtttctatcatttgccaacagcttctgcattgtctatgtaatggggaaaatgtaaaaatttatcttgtgctaaaaggataactatttcagagtaaaagtaatgcttttgggcaataaagataactatttcagtgtattatattttcttttgggctatgaagtcagatgatgactgatttaaaccacacaaatatcaacagttagactattctatttgtctcctctttaagaaaaaaaaaagtttcagagaagagtttgcataatcccaaccctaactcttcagccactatataaagtatcttaaataactatgacttagagatactggaaaaatatttggattcctctgatttatgatttttacatgcaatgttatagagaacacttcaaaaaatcagctgttgatgtatacgtgatgctctgaccccaagatacaatcaatattatttaatggagactaatttacccacacggcagacccttcttaaacagggtatatccagaagttattgggctaagtgcggcaagaatgcatgagtcagctggtggttagcacccaactgagcagccctgggccagattaggatggatacagcagatgaaagaacatgacaggttcatgctcagttttcatttgaaatgcatatgccacaaagatgtcgcttctttcacaatggtggagcaaactctccatgttggaaatgacaaagaagggacaaaagaaagataacatgaggaccttctaagccatcagaatatcaggaaacagaagcagacataaccatctacttggtgcctccattccacagaatcctccaaaaggaagtcaagaaagtccatcgttgccacagagtcctgagcaataattcaccactactggcaacatctgattagatgagctgcttactaatctcagccactgtggtcttgcagaattgcagcttatctagctttcccgtgcttatgtgatccaaggaacctgatgatggctgcataacacaggcaaaaaacagatggggaataagttcaaggtctattctctgggactgtcacctttaccaaaggtgtctgatcccactggtggacctccattctgggtccctgataagtttatctgctgataaaagtccctacatgtaccacctactcttttccttgatgaggaagccaggagtggcaaaaatgactgaaccaacaatgtctccaatgtgcctgcagtagagccccagggtggctctcttgtgttcaatctattttatacaatcatttttaaaaacacaaaaatagacttgtaggctgggagaactatccatctagtcctttgggagagtctctcaagttaacaggctaccattgtcatgaaaaggcctcatgaccagccattcaagggctgcctgcccacaactgctctgaaagacacccatattccagatactagaaacactctgctgcgactggtacccgacaaaccaacaatgagcaatgagaagctgaagtttaacatgttagccaatgccagggaacactgcaagtaaccaaagggcttcatcggggaaagagaactgaaagctttgcctgaattctgcttcacagtccaatgtgttcactgggcataaaatagtaagggctaggtaatatgttctttgggagtgtgataggcagagttcagcatcatgaagacctcacaaaattcaaatcaaacaaaagggcagagtcatgctttcttggcagttggagactgagaggtgacatgaatgtcgcatgttgctcctgaggcattttaatcagtgtcccctatgaacttcctttagcactgaatagaaaggaaagagattctgaaacagagccaatctgacaacactgcaacactcagtgtatttgctgagcccaaactgctgagaacatgtggtggttggatggaaaccagacagttaagcaacggtcgggtgagatgctgaatggaaatgaatataagctgggtgggtggacaaaatcctctaagggcacaatggcacagcttccattgccatggcccagccatcaggtgtgggggaaagcaacagttggacgatcttagccagtggaaatgagacagcttctttgagtggactctttgaagccttcaaggaaaacagcaggcagctttggcccatgagcaataggctctagagacagagagtggtgaaataacaagccaaagaataatttacatgagcatggaaggtcctggctgtcaaattgcttgggtgagccacacagagttcacgtgtttgacgacagaatcagattcagaaagatctcggttaagctggatggaccaacccagcaaaatgaaatgtaatagagataaatgggtattatatgtaggtccaatgatgaaactccaagaacatatatatgagtggcagcttagcagccctgtgtgtctaaaacttagaagttatagttgggagccatcaaagaagcaagttgatgaaaaattaatttgattaataatgtaaaacaaagaaggagacaaccctgtttacagaccaaaggctccagatgtcatccattaggaaggtgttcaaagaagaggaatacaggaagtcactgacagcatttattccgggggtgtgagaactcaaggacataaaggcttacattttaaagggttatgatgtggacaagagattgaagttattctataagcctattatggataaaatgagaagcaatgatggacactacagttcaatcattcattcaacaaatatgttaagctcctacgatgtgtcagccattgtgctaggcagcccgattggcagttaaggaaaactttcgcaatactcaagctttccagaaataaacagggctaccttctggacacaattcacacatggttgctgaagagagtaaggcaaaagttgaaatttcagtcttagactggttggaaatggaatgcatgcatcttaagctccccacctcagagaggtttacaatcatctgtgagttacactatgtacctctctttttcagttcttccacatttcaagagagatgctaaccaactccacatggtgttcagtagaaagcagccaaagccaacattggcaaatttaaattgaaatgaatggcattttaaagagaatactgggtttcccatagactctccaggagacctgcaaaaataggcttgaagacctcatcatcagaaaaaaagcccagccatgcactgcagagctggtctgggacgacgcctctgcagcgaaccatgagctcacatcactgtcaagggacgctggatggtgctacaggaaaacagcagcctggaaaccagaagaaactgccaccatcatcaccctcctcactggaagggattccaatcattctccaggtctttgtgtcaccagcctccacaagaaagtctggtgaggctgaatcagactggaagagtctgggtcacgctgggtcatggctctaagtcctggcttcaaggcgggataaaaaatcaagcactggcggtcgggcgtggtggctcacgcttgtaattccagcactttgggaggccgaggcaggcggatcacctgaggtcaggagttcgagaccagcctggccaacatggtgaaaccctatatctactaaaaatacaaaattagctgggtgtggtggcacgcacctctaatcccagctacttgggaggctgaggcaggagaatcacttgaactggggaggtggaggttgcagtgagctgagatcacaccactgcactccagcctgggtaacacagcataataataataataataataataataataataataataaaaaataaataaaataaaaataaaaaataaaaaaaacaagcactggcattttcagtttctataggtgggccctgcctcacaagaaaggggattctatgagtacactagatgctgagtttcaacaccttaacaaagaccaaaaacattcaacataaggtgtagccattcttctcccactactcatttaacaaagcccaacacttgaagacaaaaggtgagaaaattaaagttagcaacataacttccctaacttgatgaatagcatttgcttcgaaggatccttctttaggaagaattctgatggtcacagtcactcacaaatggggttgacattgactgggaattgtcccagtgggtttgagataaggcggctctcccctgaatggaactgacaggaggacaagctgaggagaaaccaggagtttcagcttgtattacggcagatgagttttcaggtcattctgctgggaaactaagtgaccaggaataacttcctagtatcacaggagtaagagaaacctccagcagtcaagaaatccaccacacagtctccccaaggcctatatttctatattaaaaaaaaaaaaaaaaacatagctggcagccccctttctccaaaagccttgagagaaagtcatttgataagtgagaactgcaggtgttcggaatgttccttgctaatgtcttgttctttctctccatatccccccaatccccgggagtgaaagcagagtggagtggaggggctcaccatctcttccatccatttccctgtggtttccagaagacagtgctgaggtcagagccaggataacctctctggctacacagtgacgcatccactggggcattccagactctgggtgacacttcattacgccagacttcctccaggaagtgtgagcaggctaatcacgcccctgggcgaggcgggcacgtggagggagagattagcgttcccccacagctgtcaagctgggcccctctcattaacacccacgactctctttctttcctttttttttttttttaggtcctttgacggcagctcgtgtacttgaagtatgtcactgaaaaacgcacagatgggatctaccagatcatgagaatgctttcacagcttttgaaagagtgctgggtttctttccttcagaagaaaaaagaaatgctgtattctcaggtctacccattttccactctcttcctgctttagaaataaactattgcagaagccaatgtagtaataaccaacagggcaataactaaaatctagatcttttgatttttttttaatgctaaagtagctaattgtatctgctaatcatgtcttcatagttcacagagagggtacagcatctgaaatatattcaacattagctgcaacctactgaaatccaacatcaggccgggaggggagacagcaggccaggcgagcgagtgtctgacagattgtgccctgagggaagatgtgtcccaaagcaggaggaagttgctcagggaagggatcttttatcttgctataaaagttctggacaagggtctgggtgctttaacatggaagcagtaagacaatgaggcctggaggaagaggaccaagaactgtgagtctgtctcggatgatccagaggctttttgagcattttaaccagtatcatctatgatcctctgaacaatatcaaagaggaaaagaggataaggttactattctctgggtggtcactgtgttctcttttgtatgaagctgtctctttgtgcatagaagaaaaggagctatgccaaggcccaacagtcctattattttctgttttagagatagggtctcgctctgtcacccaggctggagtgcagtggtttgatcacggctcactgcagactcgaccttgtgggctcaagcgatcctctggcctcagcttcctgagtagctgggactactgatgtgcaccactgtgcatggctaacatttttattttttgtagagatggtctcgctttgttgccctggctggtctcgaactcctggcctcaagtgatccctctgcctctgcctctgcctcccaaagtgctaggattacaggtgtgagccaccgtgcccagcaaacagtcctatttttaatataagttcctagttctggacttccaggtggcacctgccacacctactgcacccagtcagcttagggctttcaccaaaaaaatctgacaccaagaaaagcgggtccccaggaagcggtaaactacaagaaatggacgggatttgcaatcttcccagaaaatacccaacagcatttatctgtaaagactttgctgctgataatattacagtacttcttaaatctcagcaaaggccttccataaaaagaaggcattcactcaataaacatttactcagcaccttctatgcccatgtgtcagctgtagagctggagggtgggggtgggaagagaggagggaatctaagatgatttgataggctcgctactgcatagaaccccatcatttaaaatgccactaatacaatcttggaaattatgaagtttggggacttcacaggactttgactgataagtaatattgaaaaataattactcaaacatgcccatttatctccagcccagtacagccactattgtgcgtcctttcaagggacatcagggcagcagcacagcttaccctggggtccccctgggcaccccagcataagcagtgatgtgctagacagccaccaaaaccaaagtataactacaaaaccttgttccaaagggttctgggggagattcagggggaaaagttacatattcttaaaattttgatcactggtggatgcactcaaaatcctgctcttctctgggagcgattttcatgctgttcctgaaagctcagaaagaataggaaaattttatgttcagtgatagatgggctagacaatgggaaacctgcactgaaccagacacaaaggacctagcagaggtgacgcctgccagggctgtgcacctgtgtttccttaacatctgctgggaccccattagtaagtttctatgaaaatgaattagactgtgtgccttctggtcttgcgggtcagtctcttacctcaacaccagtgtctgaactgaacagagcttggcagattctgattccccctccaacctctgccccagccttagcctctgcaccatcttcttggctctgctctggtgtcaggagcagcaaacagtgcagtctgcagttagcaccttgtcactgctcagccataagcccctagacgtgacagaattactcctctgagattgaggctgtagttggctatctggacaacctgcatcaacttcctacacccacaaccctctggacctagatttctaccctgactctgcagccacgtaggccccttccccacagcaggtggaggagagggcaaggtcatgtctgccctcttccatcatgtgtgaaactggctgagaaaagcggggttgtaccctcagcatcctagctctgagaagaacctgcaccagccctgctggatctacccatgcagaccccacccctgtgatctcctggagagctacttcctagataaggaggtaaaactcatggagaagatgggtgcccacctgacaatcctctgcaggccagcaggccccctggcaggctgggcaagttcccccaagaaaataattgaaggcactttgtaaccatcttggacccttctctcttaagctgtggaaaaagtgcagacaatatagctttttgttggaaaaaaacagcaaccataagaaacagaatttgacaatttatcaactacaccaagaagccactctgtggtccctcaaattgatttaaataccataatatgtcatttaaaatgtggactctggaactgggctgcctgagttcaagcctctttgtatctcagtttgttctcctataaaataggcaatataagattattctcctcataggcattttgtaattacagattgcacatccctaatctgaaaatctgaaatccaaaatgctccaaaatctgaaactatttgaacaccaacatgacacacaaggtgaaaattctacacacaagcattaacacaaactttgttttgtgcacaaaactactaaaatattgtataaatcaccttcagactatgtgtacaggcatatatgaaacataaatgaatttcatgtatagactcaggaaccatccccaagatatctcattatgtctatgcaaatattccaaaattcaaaaaatatataaagtcagaaacacttctggtcccaagcatttcgggtaagggatactcaattggtttcggatggacagcaaagtgcctggcatctactgagtgctcatctaaccaagtaaatatgagctatcattatttctattaaatatttatttaaatcacggaactatgcttggttctatttctcacctcaatgaattctctatgatccatcgcgaaaatagattaaaaacccagataaggtgataaaattactgttcacctaaggaaaggctcataaaactggcttattttgcagatgtttcttcaaggctgactcttaacaactaatcgaaggccgtattgtgaacattgttactacacatggaaaatatattttgagaaataaatgataaaagttgtaatgtgaaccctgaaatcataacaattaactttaaaaactctgtcacattaaaatctactggtcttagacactggggactccaaaacatgggaggaatggagggggaaaagggtccaaaaactacctgtcaggtgctatgttcactacctgggtgatgggtttagttgcaacccacacaatacatgacaaagccctcagtatcacacaatacatctatgtaacaaatttgtacatgcatcctgccctcccaaatctaaaataaatataaaaagggaaaagtgggccaggtgcggtggctcatgcctgtaatcccagcactttgggaggctgaggtgggtggatcatgaggtcaggagatcaagaccatcctggtaacatggtaaaaccccatctctactaaaaatacaaaaaattagccagtcgtggtggtgggcgcctgtagtcccagctactcgggaggctgaggcaggagaatggcatgaacccgggaggtggaggttgcagtgagccgagatcgcgccactgcactctccagcctgggcaacacagcgagactccatctcaaaaaaaaaaaaaaaaaaaaaaaaagggaaaacggcacatggcaagaacatctctaattagtgatcaccgtagaaatgccttaagaacttgatccatatatgtgcttttgcctctgagtccaaacctatttgtctaaataccacattttgggagtttgggggaacagatttcaaacgatgtggagacaagcactgagaaagaccaccacagagcgaaggggatctatacacacagacaggcaagcacagtgttgtctctgcctaggaacaatccctccaacccgaggagaaatcctaggtctcattttaaaaatatccttcagaaaagaaatacctcttcaacccacacagttcccaatgaagtcctatgcaaaaatgcttcttacaaaaataaaataaaataaaataaaataaaataaaataaaataaaataaaataaaatttatcggtctatcttgagctctaaatgaatcttttacacatgaataattttttaacatcatgcatcggtcatttagaaaatcttggttcactgagttgtactgattttgcaatataacatcgttcattatacgacatttaaaaagcccacattcattaacattaccactgatctcatcaaaaaaattctttaagtatttaagttaaagtagttgtcaaactcctggtggcagatacaagttttctaagttctaatttttgcttaaaagctcaaattttatcattaacaacaaacactgtcagttgttttccttgaagtgacaagttcactccattcatttctgggaaaaggtctgtcaaatactcaagtttgaaaatcatagtctgtctcttacccattctttaaagtgaaatagtgtttcgtgaataaacgtagcttttctcaagacaaccatcctacctgaacaggcagaagcgccttgcacatatttcatatttatagagtattagaaagcacatactccactgttgagatttaataaaattggtaacgtttgttacttcatcaaggacattcttaagtgaaactggcattttttaaaaactgggtgttcgtggcagaaaagaacaaaatgactgctaatagcgtttggtagcaccgctttgattcctgctaagttgcctgcagtactgtcatccattgtttttacatctatctaatgtattatcaacacagtgaaaaaagacaaacaacatttttgtattattatgaagatagttttgatcttgggtatgcattgtaggcatcactgggctttcaaagactctacctggaaaatcactgccttaggtagactccttcacctctgcatgcctcagtattctcatctgtaaaatggagaggattcgcagtacatgtcctgcagggatgtggtgaggactaactggaataaatcatgtaaacaatgaagaacaaagctggcctatggagatgccatctatggactggctataaggagatcagacatcatttgaggctcttggttaatccaggtgtgacaaaaatcaccatcttagtggttttttttttttttttaaagagcatttatcagctatctccactgcatttatcaattatgtccactgagaacattcctggttattttcctgagattgttagagacaccaacaggtcagagactctttcaaatgccaaaacaactagacttctctttaagaagctgggccgggcgcggtggctcacgcctgtaatctcagtactttgggaggccgaggtgggcagatcacgaggtcaggagatcgagaccatcctggataacaaggtgaaaccccgtctctactaaaaatagaaaaaaaaattagccgggcgtggtggtggacgcctgcagtcccagctactcgggaggctgaggcaggagaatagcgtgaacccgggaggtggagcttacagtgagtcgagatcgcgccactgcactccagcctgggcgatagagctagactccgtctcaaaaaaaacaaaaaactctactcactgtaatttcccctgatgtggcctgagaacattacctagcccacttctgcagacttcagagcatgtcttcttaggggctgtcgctcaaaaacactggaggaaaaaggtggatgtttatattcatgtccttttgtgtgtctgtgttctcaaaatattgtgacaccaagagacagaagagaaattgcctggtccctgaacctgatgtgcaatgtcagttctctttggttcaacgtggttttcaaaaacggacagactctaaacaaaggtatctgtccctttagtcaacgagacagggaactgatttggggggttgttttttcctaatgatactaggttgaatttttaaaaattaaagcagatgtggatatattaggaagtaaaataaaaacttgtgtgatttttttaagacaattttttttttgactaaagaaacagaacttactgaaatgtatgattctggatcacagggcagaaggttggggcatgggaagagctacaagaatcttcattaagaaaactggtgaaatgtgaatatattctgtggattatataatagtattatatcgaagttaaatttcctgaatctgaatgattgtctgtgtttatgtaagagcttgtccttgttcttaggaaatacattgaaatatttagcagtaaaggggcatgatgtctgcaagttactcaaaaatgattaggaaaaaaacattagagtgagacacggagaaaaagaagtaaatatggtaaaatgtttaaaattgtggaatctgaacaaagcgtacataggaattatttgtattatgcttgtaacttttctgtaagtttgaaatcataaaataatcaaaatagaaagttttaaaatgtcatttaaaaaaaggacaagacattcttttgagtttcttgtgtcacttattaatgacagtgctccccaggcaatttgctccctgcttatctgtttggccttgtcctgtaccatctccttgtccagctcagagcactgcaacctctgggcccttgtctctgaccctcaagtgggccccgatctgcccccgaggcctgtggttctgggtgctccctagtcctgaccactctccaggctctcctcctccagggctgcctgttatcaccacctcagaggcctttcctgatcctcctatttaaaggagtcccctcacttccacttctgtcactctttataaccacttctattttatttatctttcaaataatattaccactgcccaaaattgctttatttacagttatctatcttcctccaacggattattctccatctgggtagagaccttgcatttttggtcgctaccacttgtgcttggaacattgtaggcacgcactagatatctgttagctgaatgaatgaacagatgtccccaggatctggcagtgggcattcaagctcttcctccaccaggggtaccgggcatggcaagtactcaatatagatgtgttgattgaatgacaatatgtgaatgagtggataaattagagaaagtttctaattctaaaaaggactagttctggaaggccggtgagctcagggattatacagagaaacccacatgcagcctggctcaatatggtctcccaggcatgcactttgacatttaccctccaaacagccccagtctggcttttgttccattgctccacaaaagccgtccctgcgaaggccattcacgatctgcatgttgctgaatccaacaggcttttccatctttcccttccatgtcactctaagcagcacttgacagagtgggcccctccctcctccttcagtgactattcctcaggcttctatggcactggcgacttccagttttttcctgattctcactctcctctgccagctcctctccaatcacttaagatccctaggggttacaaagaacccagtcctgggcctcctccacttctcactccatgctcattccctaggacatgctatgaatcccggtggctttgaagaccatttgtattctaagttgagtcctgaatgtgcatctccagcccagatttgctggctgacctccaggtacctttatccaaccgcctagctgatacaaccatttggatatctcacagaaatctcaaaatgtctcaagctgaactcttgatctttgctgctaaacttctcctttttccatccttcccgcctcagggaacatccaccttataaaccccctggatctgtccctctcacattcacttcatcagtaagtcaggacaattctgcctccaaaagatatcacacatctacgataccccgatccatctccagtgctgtcactgtatcctaaggtaccatcacctctcccccggcctgtgtcccactttccattctcgctcaactccactctttacatagaacccagaggagtctctgtaaaagaggaatcagatcatgtcattcccctgcttgagattctccaacggctttccatggccagtagaataaaaacaaaaattcttaacatagcctaagtggtcctatacgatctagtgcctccgcaccctcatgccaaaatactttctcttggctcacgaagctctagtaacatggatcttccctcagtttccctaaaatataaagacttctcctaccccaagtcctctgcacatgctgtttctcaacctggaacgtatttcctccagcttttcagctctctaagtcatccacaggctctcattcatattgaaaggttttaagaaggaaaattgcttaaagtcgagttggattttatagtggcaaaagagtagaaactgaattggagtgttgctggacataagggcaggttggtagagtgggtggaggctactaacgctgagggagagaggaagataagaaggtctaacctaacaacatttccaggacagtgaggaatacacagattcttgggaaattcctgtctcccaccattcttgggaaacattccttaaggacaatcatgggaatcagctggacatggtagccagcatggaaatgctgaagatgccctctcagtttctgggttggatgaatgactcgtcaaacagtgaagccactgagaagtgggattgagggggagatgtaatcggtatgaagggcaggaggaagatgatgagctcagtttggggcatgcatttgggatgccagggggccttcaggtacagatgtctaccacctgctgtgatggggacttgggaaaatgctaacaattggaatcaccactatgagaaatgagactgaaagtgattagaagcatgaagaaagaggctgtgaggcccatgggtggtgaaagccattacaactgatggcagcatagacagggaacctcctttatgacgagactgtcactggcactttattaaagaccatcattctatagtcagaagttcagaccatgttcacaaaacacatgaagccaggatgattatttttggaatgcaatgaaaagattaaatgaaaacataaaactattttatgagcataatatactactttgtttagaaaaatatatactgcttgtttgttactagtatgaaggttgctaaatagagactagacactatctagactctaggtgttaatttttttccattccaaaacaaagtaattcacaaaaacgtgcactattcattcatgcaataagtattactaagtcccactgtgggccagatgctattctaggtgctggagagagagtagtaagaagtactgaaggcactaaaaaaatgcatgttggatgaacacatcaaatcaaatcactctattattacatcacaccctcaacactgctccccagttccacagacatgatactatcagtcagcttaccttgattagtaatcattaaatgttgcagaaacacctaacagttaagtcctatgttgaaaaaaaatagacatccaataaaatgcaaatttgtggtaagcagtaggagaaaacaagaagcggaaagaggaaggttgcctaacctcgatggcaatattctctaggtcatccgtgagctttgagttgtgaagaaaaatccaggcaggtcaatttgaccttggaacagaattcttttggttgaatgttaagtggctaaattacaactttggggagaaacagttcttgcaatggaacgctcttccctgcctgattagacttaatcagacttttttgtactttagggtcagggaaaattttcaacctgtaatcatgtacttattgggacacactaagagttcatgatggatttttaaacacccagagccttccaaattaactcaaagtctcatgatttctccctttaatatgttactttataacaagtagattttaataaaaattaagggaaaaaaatttcaggtttctgccaggaggcactgacttgtatttcttccaagtctcatgctctctgggggtatgcatctactgaattcataaaataaaaacatagtaaatggtaaatgtaaatgtaagaagaggtaagacatttccatcaattccctaagaaaactatcaccaaactcttgatttggaaataatgaagtctcccaagtaaaagtaaaaggagggttggctaggggattcccaatgcctgccaacaaaacctggtttagactttctgttttagagcattctggccaataaacttcacagagatttaaacaatagccctttggattcactttggattccttaagtccatggactgtctttcaaatatctaaatgaaactagacagaagttagaaaaaaaacaactagataaccctaaggccacaaaattaggtaacttcagagagaagatgtcagaatttttttatgtgcatcaagtctatactcatgggcagcccaggaatctgcgggtaagaagcactgaagtgataactcatagggttgaaaaaaattccggagctgatcacggtgaaggaaacataaagcacgcagttctaaaactgttttccagattgtattctttaacaaagatacctattatttatgcttttgaaaaaagtcagtgacgtccctacacagttcataatgagttctgcagattcatggaattcctttcttgaaatcatttcctttccctgaacttctatgtttataccatccatagtatcacatccatcttccagcttatttaaattctgactgtgaacagggaccatgtttgtatcttctgggctgtgctcatcaacttcctagtagctccataaacgtgtataacaacaatattaataatattaatgaagcactacattaaaaactacagcgtgtgtatcagtatttcttctatttccttgaggtacagcaagcaacctttgtagaatttctctatcacctcgtgggtaggagaatgaaaagagtttctctgtcaagatgatttggagcttttggatagtttgctccaagtcaacagggtataaaagaatggtccttatactcttgtgtattttgccaaaggcagcaaaataaattagtcatcatttcacacgtggccaagttcacaaaccatcacatcttgccaacgtgcccaaggaccatatctgtgctctgcgacctaaatacagaaaccctagtcttaatgtccaccactttcttgagtattttatgtcctttttgattactattaatgtccatgggaacagataaagtagctacaaactcttttaacaggtatgagtatcagctatcactgtaactttcattaaaatataaaaacagttaaaaaccaaacagagcatcactttttaatattatctaaaataacaataaaggtggtcagatggttacgtgttcatttaattgctaatgaagccagaccaataagtcaaagctggattccctgtagaatatcgatttgaagtattagcagcaaggatcgtttggtaagacagatttaaaataggagtaaagattttactttccaaggattcatctttgaattcttgtgggtggttgttttatttccagcctgctaaaaaccataatatcacctgaagcaagcaggcatgagcctggaacgggagtgaaatgacaacgaaacatttgtacatgttattaaagctaatgaagcaagacacgcactgcctggttttgtgtcacgcgcccctggagagcccaactgtgttctggggctggctgtggcatctccccaggatatggctcaccctgaggcctctgattcagcggcagagctgtttttcccctcgggaaagaccaaacagacacctgaccttttataaaacctctaggatgaatcacaagtaaagttctttggcattctgaggtggtgggtggaaatcaaggcttgacaggcggccatgggatgggcagcgtgggctggcgctatgggctatgccatagcgtggagaatccctcacactaggacccctggcctgcatgtcatctggcatccagaactcccactcaatttccaaaaggtgctacccaccctggaaaaaaatctagcccactgagtagctgggaaaatccacagccagggagacagatggctcaggaagaagcaatctggaataatagtgagggtgtgggagttggagtgtaggctgggcaaggagatcagagaggaaagaacgggcatctgtatgtggcgacagatgacggagtgctgtttgggacgagcagttggaggaggcaaaggaaatggaagtaatgtacttatgcataagggctgtatcataattaggaaaattccccttctgtctaccccgcaagtcccacttggttcagatgggggcagacagcagagagcacttacttcacggaggaagcagaggctacccgctattccaacaggctttctatttctgatagaaacaaatccaaactgagctaatttgtgtacagctgcaggcaatataaacacggctatttagaattctttatagagtataggcctttgtactctatacttcatggaagttaataagtaggtgtcaaactctgaattaaaattcccagaagaggacacagcacaaaggacaataaaaatgatttttaaataatcatagggataaatagcatccacttctgacaaatgtaagtgctggcataaaatgttattaggctacagagattgtcttttgttcaggaagtatattttattctcctgcctcatcattcatcatcctaatgagccctcaaaatgtaaattaaatagcaaagacggattcatttgaaaagcatcttttcaaaaaaaaaaaaaaagctaggtgttaaaccattttttctacttttattctatatattgtttcattttttcattgaaaaaaagccctcagtacttgaacactttatggggtaagttcatgcaattcatattttcagtaaacagttcattcattctccagtactatgggattggtgatttgaaaagaaaaaaaaaatcgcattttaaaatggtatgccctgtaaatgatgtttgatccggaaaatctgagaaacctgtgcacgcattcacttttttgttttattcagaagtgatttggtccagggaaaccctcaatggaaaaggattagtgaaaatttcaaacagctttagtttactgaactgaatgcattaatggctaagcaaacaccagttcaaccattaatgataaaagaagaaggtcatgagccaaattagttgcaatttcttgttatgtattgataagaacattacccgttcctatgatgaatagagaaatcagggttttgtacttgacctgaatttatgcatgagcacacacaacagaagtgactgaacagctctgctggggaggcacccaggaaaaacacgctgggaaaggaaaatagcagcaaatcatgtctcattttggcatgattggtcctcatttgcctgtctctctctctctctctctgtctctctctctctccccctcactctccccaccctctctcactgcaacccataaatcattcttcgcattctttggctgttcctgcttatgtgagagagctcagctcccagctctctgtgggtgaacatatataaaatgaagacacaagtaactgcactgttgaggtttgcctgatgtccagggaacagccattaatctgcacaagggggtttcaaaagccccactctgccgaataaattatcgttaaccaatctaggcattctaaagacactatatttttatgaggtcaaatgttgcagaaatatcccagagggagggtagaaactatccagctgtgaaagaagctagtgacagcactgcacagaagcctggggggtcctgcagtggctacagaccggctgcagccctggctgaagcacatcctcagtctgcctggttcatgaggactgctgcatttgggaagcactcatccctcacagcagtgcccaatgcaggctcacctctagagaaggggcatctctcttggaaggtctggctgatgaaagagcatatcatgacagacaggagctcatggtaaagcctgcataatccactggccatcctgttccagtttacttactcagttatttttaatggagaattttctttttaatgtgacagaactgaactcaatgcaaggctcaaggctgtcgtcatgacagttgcccacataaagaaactgtagtctgggcccaaggcatggccctagcaatttcccagtaatgcacattttgacgggcacatcaattggtttatgatgtaagaacaacactaattagtgaggaagaagccaatgtcctgtgttgatagggcccggtgcagtttaagtgatgaagtgaacgttacttctaacaaaggaaaacaaggtattattctgcacagatatttaactctgaagaagtgttgaacaatgatagatgtattttaaagtggaattgaagcttcatccacagtttaggaagagaactggctaggatatcaataaattgttttatatttgaccccaggcaggaaaaacaacatgcaacccagggaagggatggtgccttgctgtgaaatatgtgcattttaacctttgcaatatgttaataattaatatgaattcacaccaatacgatatcttcataaaaacacagaactctcatgtataaaacctttcaagtataaaagaaataagctaccccctaaaggttttctgaaaaaaattcccattaaagaaggttctcacagtctgaatgtagagacttttaaccagacctaaaattcttgcgaataagccccatgctatatgactgacagcaccattaaaaacgctaaaaaataaaatacacgcttcattagtctcccagctgaactcagaatctctggcccagaataaatcttagcctttaagaataaattctcttctgaattaacatctcagagtcattaatctttggagtgacccttcaatttcatttggagaactactacattcctcaaaggtcttttttcttttggcaagccatgatttcatggagagaaggaaaataacatgatctttcttttatcatttcctcattctcgccctcagggtggcttctcttcccttcccaactgaaacatcctaaatctaaaatcaacagagagccttctactgagtcagcaaggaactaaaatttaactttagggatacgtgaaaataaaaacaagactaggcagaattattattatacatttcaggaagaaaggaagcattatcgtgaacacaattttaccaaattaaaaatggtacagactttattctctatttcaggggccttgtttattaagcagacagaactctgcttgattattccatgaagtcgccaaccattaatcatgcacatttgtttaacaggtcaaatgaagagaggaaatttgtgtgcagtcacggcaaatactgcctcattttacccactgtgatactaaaggtacagacatcatgttgtaactacattaggagagattggtccataaagtaatttgattataattccttcttgagcagacaactatttttgaaaagcaaataactatttattttttgattatttatttttaactgataaaaagtatacgtatttatggggttacgatgtggtgttctgatagatttatacattatggaatgattaaatcaagctatttaacacatccatcacctcacgtactttcgttgtacggcttgaacatttaaaatctgcttagcaattttgatatatacattgctattaactatagttaccacgcttatttgcttatgtatgtatgtatttatttttgagacagactctcaccctgtctcccaggctggagtgcagtggcatgatctcggctcactgcaacctctgcctatggggttcaagagattctcctgccccagcctccccagtagctgggactacaggcacataacaccacacctggctaatttttgtattttttttttggtagagatggggtttcaccatgttggccaggctagtctcaaactcctggcctcaagtgatctgccagccttggcctcccaaagtgctggaattacaggcatgagccactgcacccggcctgcttattaatcaagattttcaaagttagatgtttaattaaaggataatatgtctataccactcatccaacaattttcactgtgaagaccacattagccagctcccagaggagacacattctggtgagggggtggctgggttcaccatattcgcttctaccatcctccaatcccagcctctccctctacctgggggattcactggaaccatccatttgtattcccacattttttgtgttcttaagccagaaatgtctcccatatagcttgccaactgcccaccgcttccaaacacctctatcctctactgccacgtgaatcttaaaatagagcttccactgttcagttctccagactcaccagccgttaatagcccctcatcacctagaggataaatctatagtcctcagagccaaaagcagccctgccctcagccttctcatctggctcatttgggcaatttcttctgaacagtctacaggcgttcctattgggaacatctgctcatccatcccacctgcaatgcctttcaaaatgtgattcaaattcatccactttaccctacctcacacacaaaggcctttccctcattttccccctcaaaacccaatgaccacactgtcttgcttgatatgcattccctcctgtctcacagggctatttaacatttcacttgtttaagtcttatccatgtttccctgagagcaggaattgtgtttggtactcacatgcacacagcctgcatgtaacatcacaccttacccagagtaaagactaaaacaaaaatgtaatcatttaaaacttattttcttgttcctactttcaatcaaggaatcatgagtctcagagatactctaggcccctaaatctatatttgtgcccaggagttgctgatttcagggatgggagtttcaaagagagggtgcagggtcttttttaagtcttgacaattccatccatggccccttgtaagttttagaggttgtgaaagatactgaatccttggggttccatgaacttgtctgtagtgggtctgtgcattcactccatcatactcttggttggcagagaagctcagccacttgggccactggaacaaggtcatttggagggcagaactcagctctggggcagatcatacgcacaggattggttttggaatctatcatgtgatagagcttctccacctaccttctcttactacattaacccataagagaggcttacctgttaccaactagtttcatcacatactgtctggagatatgacaggagatactggaacaaggaacacgcagacagtgaaagtttattgattcagtttacatttaatgattgattggtagaaagagaaacaagtcctgaacaaagtgtgcccctccttcttgatgccccaaaatgcatttaaaaatctctttcaaatatacctcgtatgtaccctctgcctcatacctaacactgatcacattttgtccagttagattgcacctttcctacctcagaaaggtttacctgaccttacttgaccatgctagcgaggtctgatcaccatgttccatgcacatattttaaagttggtggagcacttactttgtccctggccagctcctgctggggaaccttgtctttaaatggactggccttagcctgtcccaacatacacatgccccaagatgctgacagtaaattacaacatactcactcgagtcattacaattttttttttttcaggaataaaggaggtacgcgcaaggtcagagagcctcctaaagcagtttggacacatttccatgatgctctctgcctgagagcagagctaaaatcatccacagtcctctactgcctccccctccatgctacaaaaatgtaaaagatgcacatttgccattaggaaaactcctcattgcattttggacttgaagtccactggagtagggccatttaaaaatggtctatataccacgcttcatgaacaagttttattacccaaactgaaaaaaattagtgatggaaaaaataaggcagatgtatattacatcagaataactgctgcagaaaaaattccaacatcatatttcatttgaagatttcttgaatggccaaagagcagtatttgtgaaaatttttaccatatgtatttaggatactttcttaaagttttattttttaaagacttcaatttaggaaaaccatgtttaaaatgcattgacttcaactcatacctagtgctgtaagaagtaatgcatctcccttaacgaaatgtccagttactcctaatttttaagatttcatcacttctctcttaacttcccttaatgagaaggctgaactagctcgcctagctgaatttatcagtagcccatgcttgaaagagaaatggttctgccctctgttgggggcaacaggtgtgctgatggaagacagatgagctaatctgttcacctgaatcctctctgtcatgttcaatttagcctcagtctttagaaacacaacctaaaaggtctaaggcaaatagcagctgtccaaatcagagaccaaattagagaccctgtccctgagtccagaaagggtaaacatactctattgtttcctcaccatttgtttttggaaacacaaaattataggagggggaaaaccttattgttattagaatcatctttcagcaagaaagacaataaattctaagacccttagccttttgtataactgttcagtcaggggagtgttagcactgtgcttgttaatttagaatctagtttatgaagctgattatctttttaaagcaacacattatccgtgctcacaaaatatcatagtattactaggaatgtagttatcacattatattgtaattatcacttaaatatctgcgctgtttaccaggaaatataagctcttcaatgtcaggagttactcctttttcaaaaaaatcatggttcataacacaacatttgaaacatgtttagcattaaataaatatttattattgctatacttatcattaaactacgctagtagatatcaactattgagttcttattgcaaaaggcatcgtgctcaactctttccatacattgtctaatcctttatggcatccctatgggacaggtattaccaccctctgttcacaggtaagcaaacaaggcttagtaaggtaggtaattgctccagatcattcagctgtgtagggaagagacaggcttccatccagggccacccaactccaaacaggcacgtccctaaatgctacactaaatatccatggacgtccatgattctgagaactagctctctgcactcactatttgtaatcaaaatcagcaagtgttatattaataacttcagaaacgctgtcatagtcaaaaatttgcatcaaatgtcttagaaatgagcctaatagtcacaatacttttcatcatccccaagaaagagacgaaaaagtatattcccaataaaatacttggatggaaaggcacaactcgaaaaataaaacattgtaaaacttcactgtaatatgagaacaaatgaagagagcagatgatgaaggtactggaataaattaaagagagctcatctataaagcatagatatcgaggacaaacttacaacttcaaatgaataaaaactgttaattaaacaggagcttcagtatacatataatgtttgaactttgtcatttaaaaatagcatttcgttttctgcaccactagaaactacattttgaacacattcaggatttcacagctacaatactagaaatgtttattccaattaaatgttacaattactctactgtgtattatcttttcctttatttctccctatttcatcaatttctttttaaaaattgtgtaagtcatgcagtttttgaaactcaccatcttacaatgacttttattcttaagtatgtcagatggacatttaactcgatgtgactttaa

SEQ ID NO: 619 - DNA, 826340 bp, Homo sapiens
  misc_feature (725102)..(725102): n is a, c, g, or t
  misc_feature (810397)..(810397): n is a, c, g, or t
agaagagtctacgagcacttaattatctgtaaaacaagttgaaacatgcctccaagatcaattttgattctagctcagcctactaagccttaggccccttggactttcttagtttgtttgcatttgcactggttactcccggtagccaggccttgaggaaaaggagtagaaagcctggatggtggctaaagaaactggttgtttaccctggggaccatccccttagagctggacctggccttttcagagaggagagaggcttgacagagacagacagaaagagacagagataaaatgagtaatgaccacagtggccttctacctttaaattagaaagtgtccaagccactgaagacatcccagacatgtggtcctaggcattcctctgttgcctacaacaacgaggaataagattgacagcactgcagtctttctattttgttccttctttcccaggttcatcatttgcagctgcatgcaggtgcagggggtccagtcccaccttggggcccagtgagaattcacccttaatctgagaggcttagtctgagaatggcaagaagccattctgtggatgctctactgcaggagagcttaaagctaccggagcagagccctccctctggctcaaggatcccccatcccctgatcaggcccatttatcacactttaacaaccaccagaaagccaacactggtttgctctcatgtgctggccttggacctccaaacatccaatgaatcataaccagaaagatctggctagtgttacaatttcaaggaaaaataaatttcactggtggctctttttctaaactcaaaccaggtaaagccaaagaggattttgttgctcttacaactgaataatacctaggcagacaagccttctggcagaacatgattcaagtgatgtcaggagcccttgatgtctttccaaagctacaaaagaagattggggtactgttaccaaaagaagaaagagatggataaaagtctgtttcagatatacatagtatatctgggtagaattattttttcttctctctttttcttcttgttggatcctggtacttctcatggataaagtaatggaaaggaatgtttgcaaagcaactccaaaaaatgatggagataatgtgatacatgagagaggataacagaaagttaacctttacagggcaagatgtcaaactggttctttaaaacaatctactcaggggtggagccaagatggctgaataggaacagctccagtctacagctcccagcatgaacaacgcagaagacgggtgatttctgcatttccaactgaggtaccaggttcatcacattggggagtgccagacagtgggtgcaggacagtgggtgcagtgcaccgtgcgtgagctgaagcagggtgaggcattgcctcacccgggaagcacaaggggtcagggaattccctttcatagtcaaagaaatgggtgacagatggcacctggaaaattgggtcactcccaccctaatactgcacttttcgaacgggcttaacaaatggcacaccaggagattatatcccgccccttgatcggagggtcctacgcccacgaagcctcactcattgctagcacagcagtctgagatcaaactgcaaggcggcagtgaggctgggggaggggcgcccgccattgccaaggcttgagtaggaaaacagcagccgggaagctcatgagtggagcccaccacaactcaaggaggcctgcctgcctctgtaggctccatctctgggggcagggcacagacaaacaaaaggcagcagtaacctctgcagacttaaatgtccctgtctgacagctttgaagagagtagtggttctcccagcacgcagctggagatctgagaacgggcagactgcctcctcaagtgggtccctgacccctgagtagcctaactgggaggcatcccccagtaggggcggactgacacctcacacggccgggtactcctctgagacaaaacttccagaggaacgatcaggcagcagcatttgcagttcaccaatatctgctgttctgcagccaccgctgctggtacccaggcaaacagggtctggagtggacctccagcaaactccaacagaactgcagctgagggtcctgactgttacaaggaaaactaacaaacagaaaggacatccacaccaaaaacccatctgtacatcacgatcatcaaagaccaaaggtagataaaaccacaaagatggggaataaacagagcagaaaagctggaaactctaaaaatcagagtgcctctcctcctccaaaggaacgcagctcctcaccagcaatggaacaaagctggacggagaatgactttgacgaattgagagaagaaggcttcagaagatcaaactactctgagctagaggaggaagttcaaaccaatggcaaagaagttaaaaaccttgaaaaaaaattagacgaatggctaactagaataaccaaagcagagaagtccttaaaggacctgatggagctgaaaaccatggcacgagaactacgtgatgaatgcacaagcctcagtagctgatgcgatcaactggaagaaagggaatcagcgatggaagatgaaatgaatgaaatgaggagagaagagaagtttagagaaaaaagaataaaaagaaacaaacaaagcctccaagaaatatgggactatgtgaaaagaccaaatctatgtctgactggtgtacctgaaagtgacagggagaatggaaccaagttggaaagcactctgcaggatattatccaggagaacttccccaatcgagcaaggcaggccaacattcaaattcaggaaatacagagaatgccacaaagatactcctcgagaagagcaactccaagacacatcattgtcagattcaccaaagttgaaatgaaggaaaaaatgttaagagcagccagagagaaaggtcgggttacccacaaagggaagcccatcagactaacagcggatctctcagcagaaactctacaagccagaagagagtgggggccaatattcaacattcttacagaaaacaattttcaacccagaatttcatatccagccaaactaagcttcataagtgaaggagaaataaaatcctttacagacaagcaaatgctgagagatttttgtcatcaccaggcctgccctaaaagagctcctgaaggaagcactaaacatggaaaggaacaaccagtaccagccactgcagaaacatgccaaattgtaaagaccatcagggctaggaagaaactgcataaactaatgagcaaaataaccagctaacgtcataataacaggatcaaattcacacataacaatattaaccttaaatgtaaatgggctcaatgctccaattaaaagacagagactggcaaattggataaagagtcaagacccatcagtgtgctgtattcaggaaacccatctcacatgcagagacacacataggctcaaaataaagggatggaggaagatctaccaagcaaatggaaaacaaaaaaaggcaggggttgcaatcctagtctcggataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctagaaagagacttagactcccacacaataataatgggagacttcaacaccccactgtcaacattagacagatcgatgagacagaaagttaacaaggatatccaggaattgaactcagctctgcaccaattggacctaatagacgtctacagaactctccaccccaaagcaacagaatacacattcttttcagcaccacacctattccaaaattgaccacatagttggaagtaaagcactcctcagcaaatgtaaaagaacagaaattataacaaactgtctctcagaccacagtgcaatcaaactagatctcaggattaagaaactcactcaaaaccgctcaactacatggaaactgaacaacctgctcctgaatgactaccgggtacataacgaaatgaaggcagaaataaagatgttctttgaaaccatcaagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcgaacacattcaaaagctagcagaaggcaagaaataactaagatcagagcagaactgaaggaaatagagacacaaaaaaaccttcaaaaaatcaatgaatccaggagctggtttttttgaaaagatcaacaaaattgatagactgccagcaagactaataaagaagaaaagagagaagaaacaaatagacgcaataaaaaacgacaaagggaatatcaccaacgatcccacagaaatacaaactaccatcagagaatactataaacacctctacgaaaataaactagaatatctagaggaaatggataaattcctcgacacatacaccctcccaagactaaaccaggaagaaattgaatctctgaagagaccaataacaggctctgaaattgaggcaagaattaatagcttaccaaccaaaaaaagcccaggaccagatggactcacagccgagttctaccagagatacaaggaggagctggtaccattccttctgaaactattccaatcaacagaaaaagagggaatccaccctaactcattttatgaggccagcatcatcctgataccaaagcctggcagagacacaaccaaaaaagagaattttagaccaatatccttgatgaacattgatgcaaaaatcctcaataaaacactggcaaactgaatccagcagcacatcaaaaagcttatccaccatgatcaagtgggcttcatccctgggatgcaaggctggttcaacatacacaaatcaataaatgtaacccagcgtataaacagaaccaaagacaaaaaccacatgattatctcaatagatgcagaaaaggtctttgacaaaattcaacaacccttcatgctaaaaactctcaataaattaggtattgatgggacatatctcaaaataataagaagtatctatgacaaacccacagccgatatcatactgaatgggcaaaaactggaagcattccctttgaaaactggcacaagacagggatgccctctcttaccactcctattcaacctagttttggaagttctggccagggcaattaggcaggagaaggaaataaagggcattcaattaggaaaagaggaagtcaaattgtccctgtttgcagatgacatgattgtatatctagaaaaccccattgtctcagcccaaaatttccttaagctgataagcaacttcagcaaagtctcaggatacaaaatcaatgtacaaaaatcacaagcattcttatacaccaataacagacaatcagagagccaaatcatgagtgaactcccattcacaattgcttcaaagagaataaaatacctaggaatccaacttacaagggatgtgaaggacctcttcaagggaactacaaaccactgcttaaggaaataaaagaggatacaaacaaatggaagaacattccatgctcatgggtaggaagaatcaatatcgtgaaaatggccatactgcccaaagtaatttatagattcaatgccatccccatcaagctaccaatgactttcttcacagaattggaaaaaactactttaaagttcatatggaaccaaaaaagagcctgcattgccaagtcaatcttaagccaaaataacaaagctggaggcatcacttcaaactatacttcaaactatactacaaggctacagcaaccaaaataacatggtactggtaccaaaacagagatatagaccaatggaacagaacagagccctcagaaataatgcctcatatttgcaactatctgatctttgacaaacttgagaaaaacaagcaatggggaaaggattccctatttaataaatggtgctgggaaaactggctagccatatgtagaaagctgaaactggatcctttccttacaccattttcaaaaattaattcaagatggattaaagacttacatgttcgacctaaagccatgaaaaccctaggagaaaacctaggcaataccattcaggacataggcatgggcaaggacttcatgtctaaaacaccaaaagcaatggcaacaaaagccaaaattgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcaggtgcctgtagtcccagctactggggaggctgaggcaggagaatggcgtgaactcgggaagcggagcttgcagtgagccgagattgcgccactgcagtccgcagtccagcctgggcgacagagtgagactccgtctcaaaaaaaaaaaaaaaaaaaagccaaaattgacagatgggatctaattaaactaaagagcttctgcacagcaaaagaaactaccatcagagtgaacgggcaacctacagaatgggagaaaatttttgcagtctactcatctgacaaagggctaatatccagaatctacaatgaactcaaacaaatttacaagaaaaaaacaacccatcaaaaagtggccaaaggatatgaacagacacttctcaaaagaagacatttacgcagccaaaaaacacatgaaaaaatgctcattatcactggccatcagagaaacgcaaatcaaaaccacaatgagataccatctcacaccagttagaatggtgatcattaaaaagtcaggaaacaacaggtgctggagaggatgtggagaaataggaacacttttacactgttgctgggactgtaaactagttcaaccactgtggaagtcactgtggcgattcctcagggatctagaactagaaataccatttgacccagccatcccattactgggtatatacccaaaggattataaatcatgctgctataaagacacatgcacacatatgtttattgcggcattattcacaatagcaaagacttggaaccaacccatatgtccaacactgatagactgggttaaggaaatgtggcacatatacaccatggaatactatgcagccataaaaaaggatgagttcatgttctttgtagggacatggatgaaactggaaaccatcattctcagcaaactatcacaaggacaaaaaaccaaacaccacatgttctcactcataggtgggaattgaacaatgagaatacatggacacaggaaagggaacatcacacaccagggcctgttgtagggtgtggggagttgggagggatagcattaggagatatacctaatattaaatgatgagttactgggtgcagcacaccaacatggcacatgtatatacatgtaacaaacctgcacattgtgcacatgtaccctaaaacttaaagtataataataataaaaaataatctacccagagcctctatcccttttttcatcctcatgatttgaagtttccctctccttaggaacagaactgggtagaagagagaatgactgccaacccacaaagtggaagtggtattagggtggaggaaaaaaaggagctggaaggaaagagggatgtttggagatgggaagagaatgtgaatgagaggttctatagctgaagtgttggccctgcagggatgccctaaaaatccttagaggctgggcactatacccaaagccttagtattctttagactcagtaaaggttgaagtaaataatttgtaaaaccttctttggagttctggggtgtgtttgtgtggatgtgtgtgcacacgcacacctggttgaaggagggaagcaccaggaggtgcctggactccccattctggaagttggggcatgaacagagcccttaggatagaccaacccatggatcagttccctttttctttgtaaatgattgctctactctctctcctccaagatcagtttcatctacaatcattcaacagctatctgctgaagggttaatgtttctatagaaaggcaacatacttcagtgcttttatatatgcccttggggtcagatggacctgggctccagttccgtttttgcctcctgctatacatgggacctggagctgcccatgggaccttggactttgcatgggatcttgagctgtccacagaaccttgagcatgctacttatccttgcagatagtaagctctcaataattgggagacacaataatgatgcaggttcctatgtctttactgggtttgtctagggatttggggatgtgagcctgagggtccaattggaaaaaatctcaacttactgaatagtgactgaaacatttgaggtgtgaatccctgcactttgacagtgcctggtgtgagaccatagtgctacttacctgagctgtactttggtttctgtatcttggacagtgtgtttgtatggggtgagtggtgaccaagatgactgctgctcccatcttacaggactatgttagaacctggtttggatcttgctttgtgaattacaaggggtgggggccaaggaacagggtatgggcaggggaagaaatagaggggaggggatgcctccaactaccagcttttgagagcaatactgtctccctctccttgtgctgtttggggcaagaggtaaggcagccagtggtgtgtggaacatctcagtctcggtgcacaacattctcacctttgtgttttccttggaaacagaggcctgccagaacagtgaacttatcccctaagcccaacccagaggtttattcaagaaagtgtctttaaattcatctgctctaattcagagtagtgagagatcattttatatgctctgagctgagagggaagaaaaacttcttatattgtttccttgggatatatggaggtatgagttgagttctataattctagaaattatgacaacgcatccataaagatgaggcagaatccccatgcagcagttccggtagcttaaaggaatattatttaatacccattcatgggagtgtggcagaatttaaagacttcatgtaaccccttaatcactgttggaaaatgagcaagctcaggccaggtacctggaggcttggaagcttttatggaaggcttggtatctgaagttgtttggggtctgttcacagttattttgtgtacttctaaagagtgattgagcctgtttaatctacatttaaatctctctctgcttaaagccagcttcttacaaaaaaagttctgattcaatttaattccattcaattcaaattaattcaattaagggaattagttgagcagctagttggtgccatgtgaggcctgtggggaatctaaagatgaactggaccaggcctctgatcccccaaacagaaggggatgttcagcaattgctacttaaatctccacgaacaagagaattaaggaattactggaacttgtacacagttctctgaccagaattagcctattcttttctattttatatgttttcatcttcatctccttgtcttacctaataactaacacattcatttattcagcaaatattaattaagaatctatttatgcctggcagagaggcagtgtggggagaacagctaatcattctcatttgtttgcagcatagcttgataggaccaagaacccaagctggagaaccagatggtggggctgtgaaagaggacaagtccacagcctctctaagctccagttcctcatgcacacatggaaataatattaataaatccctcacatggcagggaggactaaaggagctaatgtgtgtaaaaggttcaggacctttactagcaagcacatagtgggtgcataatagctgctatctatctatcatcatctttgttgcctactttagaacagaaattctcagagctagaaagcagttgcattttatggatggcaaataaccgccaacacttgataacaaatgatacatgtcaataatgaacacatatgaataaataaagtactaacagatatacttaagtgttctaaacctctccctcatgcctctgcctataaggaagactagatctcatgagctgcaatattctttatagcactgaatctgggccaggtaaataggggagagtgaaggaggcaagaggccaagtggagctatgggataacacacggagatggagtcatatagagaaagactaggtaggtttctgcagaactggcttgggaaagaatgtgggggacacttggaagaaggagaggacagatacttgaggtagcccccttgtgtctgagagagagagagagagagaggatgctggtgatgagatagaagcccagggcaccactggtttcctgggcatgcaccctgtgcaatcacacagggcccagcctccaaagggctctgcaccttgtttaatgctctgctgttgctctctggaaattcttataatttttaaataaagggctctgcattttcactttgcactgggctccgcaaattatgtagctggtcctccttagggagagatttgtgtaagctttgctctgagaaatgaatgcaatccccttttagtgttttcttgagccttaaacagctttcaactatttgggggattatccaaccacagatcctttgactaaggctcaagactaggctcggccacggttgttcagctttacccagatggcggagcggaagagcagctcttcactccattctggctggaggagccaccctgcacccctcccagcccaattcatttgtagaagggatgggaaacccacaggcaacctccggcatgtgctcactccatcagcgtcagaagaaatccaacacaacactctactctccattccattattctggcaggttgttccccgctgagagaaaaggctcgaggtgctcctcgggggctgagataaaggaagcagtgttcctcgaaatgttgtgtaggacatggagaatttctcactgaagaagttcaagcttgggaagaggcacacttccgcttctgggtggattttgtgcagatcccctttcttttcctgccgcttacattgcaacagaaaggcaccatgtagagagagcaacaaagtgctctgagttcagcccattatcaaacggtttcaagggtcattttgatcttgtcaggatcagcaggctctctttcagcagtcctaaaaaggctgacagaaacaataaatggacaattttgaaactctttgtcagaattatactttgggggcaaactcggccataaataccaatttctagtccccctcgccatttaccaatccaacgtcttcagatctgattgccccccttctctggccgctgcccggccatcagtttatctcgccaacattgtgttagccagtgattcgcaggcgcttctgtgtctgctccgtgatgcttacactacaaagggcctgatgtgatgtatacctcggagcctgcattcgtctctaattcagtgcctacacatatctgtaatagctgtattgaactggagctgagaaaaatcacccttgccaccctctgtttttagggagtctgtgataggtttgaggattaccctatcgatcactagtcagcaatgattacctctcaccctccttctgcctcgtcaataaatggcaccaaatatcaatcccaggagacacattcaaaaccggggtgtcgcgagctgtgaatagaattataaatacagtgcaatttaaaggaaagcattcaagcccaagagacacatcagaagagatgccacattctgtaaaggatttagactttaagagtattaacatttcttttataacagattgttccgctcatggaaattacaattactgtcatttttttgatactgacaatgcaaattacatatattttctccagacatggtatttaaactaagtagtgaaagatggcagcaagtagttctaaattaatttcgaaaagtgggttgccttaactttgtagatctgaatgtcttcatgaaaaagtttcttggtgacttgttgaaatgccccagctctagattgaagccagctgatttcaaacccctaaggaagaggttattttggcatgaagaactggaagtaaagagcactttataaaacagttaaaaaaatctatactccaagtattttaatgagactgacagatgtccaattaaagtgggggcctgcgaaatccacgcacctctcatttgaaccagacagtgatgggggccagcattttctatattcagtagaatgctcacttcacaaggtcttcatagatattatgtcagggcatggtggcgcatgcctgtaatcccaggtactccagaggctgaggcaggagaattgcttgaaccctggaggtggaggttgtgttgagccaagatcatgccattacactccagccctgggcaacaggagcaaaactccctctcaaaaataaataaataaatcaataaatcaataaatcaataaagctctatgataagatacacttaagattctctgagctgaacaaagtcaaaagagctatcttattgtaggaattttcagtgctttgaatttgctaaactgcctgtgaatgtcaaagagtggagggagaacacagtacagaacacttctcaaacttgttggaccttgggaaatttttctgaggaacatttcaggggattagagttctgaaacccactttgagaaagtcctgtcttggttcggggggcatggataagatggtgaatgagacaatgctggttgtacagtgctgtaattcttgtaaaagcactcagtggtctcaggccctgtgaccatctgggctggtgtttggaggcatcacgattttctccttctcttgtggggcttctttatgaagttcagagaacagtccacagtgattgggcaggaggaagcataggctgcagctccaaaataccaggttaatttgcttgtgtgtaagtgatcttcgaagtttcattttctcttgagagttgaggatgagagaacaaatgtcaagtgtgtttataccctgtgaaaggaaagtacaattgagaaccatgtggtactccccagatgcctcagccagagtgctggagttctagtgtcagcaaactttgactctgctggggtttcagtgggataagttctgtggaacacaggaatgcctgaatcctccctagcttataagaatctttataatctgcttaatcaccctccctcttccctcctgtatgaagttttggagagtgttatatatctaaggaagaagaatatgcttgaagctatcactttgtttacagctagattatataaatcagctgccagcctggagaatgctggaaaaagtggaaaagcaagaggtggacaggtaagcatcaggtctgtaaagaaaaggccctgacaacaagcctcgtcccatctgacgttgtaactaaggggcagggcaactaagggagaaagaagagtcaacaggtgaggccctggtctcagcctgcctgattggatgttgtactgacacttgactccacccctggcttccccttttcatgaaagcatctgaaaccctaggaagggccgaaccacatctctacactaacatcacactaaccaccaggtcctatctgtctgaagagaggacgtctgatccataaacacatcctgacccgggaccaagactggatgatgaaaggagacagggtttgggctacttcttcacctgctgaacaaacccatatacacacgcctcttttcctctaaaggagttaagtgtacaatttgattgaccagcaaatgggtcagagatgataagattaagccatatccctcatgactttctttctctgggtaacttgagtctcatctggaagggctggtttttcatttcaagcctggtttgttctaatcctggccctgggatcctagactctgtactgaagaggcttccgaaggaccagctggtctgcttatccacactcaggtacattgggactgcctcagagatacagagcttctctatgttttaaaacttgttttcctaataagaaatgtttccttctatgtaacctcatggtcttgtactgctctttgtcgagacagaaaacagctggaggtattgtctgtgggcatcttctgtatgcttcaagattctcagttttactttctgcaagctgaaaaatctagtctccttaacctctttttacaagtattctttttcttcctgtatactatgtttgtgagtgttccaagataaagtttccttaagtttgttaatcattgttaacatctggaacctttctaaacataccaaattgcacattactctccagacttcctgtacaagaattacaggagcagaggttgtttggagcctgagcaggaattatcattcttaaacaggacaaataaatcattgtgatctttttgaagcccaacttaaagttctccctttctcagggaatggaacctatttttcagagggatccctggcaggtcggttggcactagcatcctgaagggacacctggtctgaagacggccaggcagaatcttttccccagaatttagaaatggaccttattaccaggagatcaatctctgagggtgactagaagtatgatatgaagtaaaaggagacaaaattatggtatgaagatagagaagcagggaaagatggtttgcagagaaggggtagaatgaagcagaagaatgaagcagatgctctctaagagattcaagaggaaaatggcaaagcattccagtgactttccaggctttggttccagtctctgcattcctactctggagttcttgtctatgttgtttttgcccatcctagtgttatagactgaattgtgtctccccaaaattctgatgttgaaactctaccgcacaatgtgacttttgaagatcgggccttcagagaggtaattaagatcaaatgaagttataagtgcagggtcctaatctgaaaacaaaacaaaacaaaacaaaacagaacaacaacaacaacaacaacaaaactgacattcttataagaagaggaagggacaccggagctctctctctaccatgtgaggacattgtgaggagctggctgtctgcaacccaggaagagagacctcaccaggaaccaaccctgacaataccttgatcttgcacttccattctccagaagagtgagaaaataaatttctgttgtttaagccacccagtctgtgatagtttggtaaggcaacccaagcagactaatatgcctggctaaagtggattctcattaccaaccaccaaaatggcttaaccaaatatagaactaacagctctaccgggacaggtaaataaggtcacagccaatgtcttctgtctccatggactcaccctggcacttttctatttgcttttctgagacacattgtgcggtagagtttcaatgtcagaattttagggagacagcatttagtctataatactagggtgggcaaaaacacatacctccttgacttgaatattttgttgacaacatataactagacaatgttaatatgctctaaactcagaatgagtgctggtcatttttttcatggtctgccatcaaaaaaattctaccaatttattctcctagtaggaaagaaaaacaattaatgtttactaactgatatattcacccaacagcctgtgacatcagttctattatttacctattttacaggtgaggaaactaaggcatttgagatggtaaataactttccttaggtcacagaactcataaatgatgagaccaaaacttgaacccaggtatgactacagagcccaagatttcaaccaagttgctacatttgggatgaaagcaaagctcaattgttaaaagcaaaactctcttgatgctacatgaaaagtaatgtgcaataacccatttctgtactaacagagcagtccagttaggactctacaggaaaaagcaaacaaggtaggctaggggcctccagtaggcttgtatatgacccaggacttgaattgagtccagataacagtggggttgaaagatgttgccattgtaacatccgtctcccccgttaaagagatatctaattttactgagatattcacttcttccctaagtagctcacatgcaaggcaaagctgacttcacccctcccggctttaggaaaatttcttatttttctaagcataaacccatcctccttgccagtgattgggcacgtgatctggtttaggttaatacgatgcaagagattctctcttctgatctggatattactattactggatgttaccagatgttagttactgccactaaaacgcagcatagcaaaaccccacaagagcatttagttagctggtctaggccttgctagttgggccagctcagttctcttgatcgtctcttggctcaacagtgagtttagggggtcagctcatctagcttaggttctacactaagtctcccatgccttctcatgaccagaaggctagagtgtgcatgttcttctcaaggtgatggcagagatataagaataccagtggaaatacacaggcatatctcaagcctagcctctgttacatctgctaacatcccattggccaaaaaacagtcaaatggccaagcttagtatcaagcccacctgctaaatagccaaactagatcacgtggccaagcctgccatcagtggagtaggaaagcatacacttccctgggagtgatcgggaggaagtgatattctgagtaataatctaatctactacagggccatgcatggatgtgaagccgagaaccataacagccttctccctttcaacctaaaatgaagccaacacacagagagaagaggggattcacaagaaccccaggaaaagagatggagctgctggatcaaatcaactcgaagttctacccaatctctgcattggccaatgttgacattacgcgatgctgaaactctcattcagagaacactccttggaacacttaggaacaaaggtccagagatgtgaataaatgtgttgcattgggggaaagaaaaacaatgcagagagcctagagagatcattttttcccaagtgttttgtccttggaaacccaatcaagccttccctttatcatccactcaccttgcagcagatctatttcttcttgattttgtgtaatttgattcattctcagatgtttgttcatctgatcttacagttggtatggtaacggcctgactgaactgtggtgtttatttttcaccacaagctcttgtcaagtcaggaagaatcacctttgccttctttcaagcagtacaggggactgagatattgaggaggaggcatggccttgtacccctactggggtcgatgctggaaaatctcctgttaaaactctaccattttccttcctctgttcacattgattgaggtggttccttcctttctgtagagctcttgtctccttgccatggaaggcaacatttatttctatcccccaccccctctcatgtgacattaataacaggacacaaattgggtgggcaataggtcaaagaatttgtgaaagtcacattcaaaaaaatactgtaaagaagcaaaaggagatatcttagaatcagaattaatcattgaaaataatacttataagtatttactaactttgtaactcagttaagaagttcttcacaccctagatgttcaaacattgagggagaacatggctaatatttattagatactaccatgagctaagcactatgtgtggcctaccatacacgtgactcattcagtctcacaatgacctggggaaacaactataatcatctccactttatggagaaaaagaacttttccaaggtcttgcagctagcatgtagagggtctaggatttgaatttggaacttgcaccttcattttatttctaccacactatactcttttgaacagaagatacatagcacacttgttctgagagtagacttgcctataagaatagtaaaatctggccctaccatgtactaattgtgtaattttgaccaaattacttaacctttctctgcctcagtttcctcatttggaaaatgggaataatccaaactctgccctgtcattttaggaaagtcccttatccccctgggccttactttcatgtctctgtaatgagggacctgcactagtgatttctaagggagcttttgtgcaaacattcagccatattctgggcttagggtcatgattttatatcagtgcagggcagtgaaaagagaagaaaagagaagcttcaagaaatatcttacaaacataagacttggtggctgatttcatggaaaaggcaaagaaggagcttgagtaaaagatggctctgagctttagagcctggaggaaagatatatttatttttaaatcatccaaaagccactcttgctattgtgttagttattgtctccatttgaccaatgaatcaaggttttaaaatatccatttgctgtcccttattcgttattcttctgtgaacaagcttagtccataacggtctaaaaccatcagcagctcattagtcatcagaagatttgtaactaagtggtaatagagattcctgtaatctggacttcagagctaaaggaacgggtatccagtgatgaatcgtccaggcagggctctgaaaggtgtcctaatggatgcagcaagtgaagatctgttccagatggacatatctgctgctgcttttctgttcctcacgcacaacacaccttggctcagccatcctcccttcttgcaaaggctcctagactaccctctggcaggaagaatctaatccatccttcaaagaaaagctcaagctgttcatggaatagacacgtatggagccaggctctgtgctaggtgccagcaatgcaaagatgaaagacacctgtctcaaagagctcccaccagctgggcctggggcatcatccccaagctcacaccttgtcattcattttgcttgtctattcatggtggttaattcctgaggacaaggacttttttcatactcttcatgatacttatgtgctgagagtgggtgttgaaatgtatttgtactttgttttatttgggagaaaggccttattgtgtagcagctaagagagaaggccatagggttatatggattgggttcaaattcccctccaaacctatagctctgtggcttattaggaggatgactaggacaagttatttagcctttatatacctcagttttctcgtctgtaaaataggtgataggtaataatagcatcttttatttgaaatttaaacaaaatattgaacttggcacatagtgtggtctcagtttacatggttactgtgttttaatgattatagactttcgaagattcagtgtataatttacagtgactgaggacagatgcctgcctgtctcttttccttccttcctgcctgcctgcctgcctgcctgcctgccttccttccttccttccttccttccttccttccttccttccttccttccttccttccttccttccttccctccctccccccccgttctctccctcccttcttttcttttccctcttcttttcttttttatctttttcctctttgtctctctgtgcttgtctctctctcccattctctctctctctctcatctctcatcccgtctttatcacagcaagggtagttattacttagaaattatatttatagataaaaatatcgaacaggcagtctccatgagttaaatccagactgattcctctttgctgaaaagacaggccttattgttgttcttcttatttgcttgcgcaaggatttcttatgcagccaattcactcagaatttgccaccagcacagatccacttaggaacctgaccaaaaagcagtagaaaaaaacaaaacatcgatgcatttttccctctagaacctctgcctgactttctagtagtggtatgctggctctccagaaagaaaagaacaagagaggaaggggaaaaagccctgagttcttgccaatttctgtggtgtgttaccaccatggtcaatttcaagctaccaatataacaccacagaatgtgagttgggagaggggtgcacagtcagttcttaagaaccctatgcacctgcttctgcacaccactgttccaggaatatgcagacccaccctcagctctcaccctgtccacgcctctctcctatatccagagggcttgtcccagccctcatcaccactgtcccagattctctctcttccttcttctattctcagtcctcccctccgtctcccaaaataatctgctaaaacccagatcagaatatgctacttccctgctgtataatctccagtggcttccctttgttgccccaggcccttaacccccttcttcacccttccccagagttactccaggcctctcatcttgacgcaagcccttctacatctccacatcactgcccacgcctaacctactgcctggaacaccattcccagtgcaaccagccctggcttttttgtgtccctggtgaatttctacttacctctaagtttcagctcaaatgccctgtcctgcataacgtttatgaccttctatcctgctctagctgtcattgtttccttccctctctaggtttctttgatacccttctctcatattctctggcatatgtaactagttttctggtatctccagatagtaagacagtgaggcagccatgggtccaggattgatggatcattcattcttcacatattgcatccaacagatatttatggagttctgggtatgtgccaattaacatgctgggtaagactaggggtagagtggagagcacgatagactgtcctctgatggagctcacagtatgctgaagaatatgggcattgaacaaataggaaaaataaaaatataatggcaaataggttctatgaaggaaaaaaaaacccacaagacagcatgagagaaattccaaaactagtgaaaggtttttaaattttcagaagcatagaatatatacttttaaagtcatgagggcctcactcagggcactgaacaccatagcatgaattgtattgtgcagcaggaaccctgcctcaccagcttagaaataagagcaagagtcatgcagttctttcactgagttgatgacttggggggagatgtattatatctttgtatctctattaattaaattttttggtctccagtgacagcaaattcaagtaaaatagacttaaggtggaaaagaagaggtggatgaattggctcacgtaattagaaaatccatagttatactcagtgccctgatcttggtttccaataccattctgcaatgaaaagaaccagggctctttggagaaatggctgattctagaactggtgtagaggatatacaatagtgagcctggaacatctgatagtatcagaaagtaagaaagtgttcagcttttacactgttggtgggagtgtaaactagttcaaccattgtggaagacagtgtggcgattccttaagcgtctagaactagaaataccatttgatccagggatccaattactgggtatatacccaaaagattataaatcatgctactataaagacacatgcacacgtatgtttattgcggtattattcacaatagcaaagacttggaaccaacccaaatatccatcaatgatagactggattaagaaaatgtggcacatatacaccatggaatactatgcagtcataaaaaaggatgagttcatgtcatttgtagggacatggatgaagctggaaaacatcattctgagcaaactgtcacaaggacagaaaaccaaacaccgcatgttctcactcataggtgggaattgaacaatcagaacatttggacacagggcagaaaacatcacacaccgaggcctgttgtggggtggggcggggagagatagcattaggagaaatacctaacgtaaatgacgaattaacgggtgcagcaaaccaacacggcacatgtatacatatgtaacaaacctgcacattgtgcatatgtaccctagaacttaaagtataataaaaaaaaagaaagtgttcaaaacacagcacacacgcctgcacacagacacagatatggcacatcaaagggacacagaaaccaattaacagagctcacaatggccaaagctgagataatgtaaaataaataaataagtataaattataagccaaagtatgaagtgagtccatactgacagaaatgattgaataagtaaataagtgggggagaatagacaaatctctctctctctttcatttttgtttctcagagttagggtctcactctgttgcccaggctggagtgctgtggcacgatcacagctcattgcagccttgaactcctgggctcaagtaatccttccacctcagcctcccaagtagcagggactacaggcatgttccaccatgcccagctaattaaaaaattgttttttgtagaaacaaggtttctctatgttacctagccaggtctcaaactcctggactcaagaaatcctcccgcctcagccttcaaagtatcgggattacaggcatgagccactgcacccagccaagaatagacaaatctcttgtgtagaagaatttcaaataatttgtatagaccttctgtcctcaaaagggaggagcgtaactccctaagtttggggtgcacaaaatgacttctttccaaagagaacaatagggaaaaggggaaaaagagtgatttaacagaggagccacctataaataatacctcagccaagtgatcaaaattagcatgatatggtgtgataacaatggcattttgccatgtggtctaactccccccaaacccatatcccaggctaatcatgagaaaaacatgagaaacctccactgaagaatactcaataaaactgatcagtattcctcaagactgtcaaggtcacccaaaacaaggtgagtctgagaaactgttaccatctagaggagcctaaggtgacatgatgactaaatgtaatgaggtcccctggatgggatcctggaaaagaagaaagacattagatgaaaactaaggaaatctgggtaaagtatagacttcagttaataacataacaatattgccttactagtggtaatgtacaatgctataaaatgttaacaataggagaaaccaggtatggagtctatgacaaccctctacactaccctcacacttatctgtaaatctagagccattataaaataaaacattaatttaaaaaacttgtttaagtccagagctcaacaagcttcagatatggctggagccgggatcccaaatgatgtgaacctgaatccatctctctgtatttcaatggtgttggtttagcttttaggtaagctcccttcacttactggaaccccagccaccctagacttatattatgctagtggaagagaagttcatttcctaatagttttaaccacagcctcaaacttgggtcatgtgtccattccggaagcaatcagtgtggccagtggtatgtgggactctgattggccagatctccatcacatgcccacctttggagctagggtgcagtgtgccccaccccaaccagagagctgagagtgaagaagtgttgtgacttgaacaaagggaaatggatgctattcaggaaaagcaacagatgtcaactacaaaacacatccttcaagtgaactcaaataattgggtgatgtggttggggtgagaattcatgttaactgtgaagatagacatgggaaacccagggaaatgcagacaataggaactctgggaagtaaggatcttataagagtggaaacagctgtccattgtccattcaggacccaagggagctctagggacctgggcaatgggggtgtggatattctttctgctattctgcttctaaggggacacagcttcttcccccaccacccaccatccattttccgggcttctgtgaattttctagttcctatccaagatggaagcagccccttgactaaagggccacctgggtggtctctggccaacctgtaaatgggccagccttgggtcagtggtcacctctgctccagccagtggccccagggactggtgctgcttacctgagctgaagctgtggactgggtactttcaccatgaggaggaagttgaggcaggacacatgccatcactgaaaaatcctcaatatcgcttcaaatttttgttgggaaatttattttctgcatgtcctcatttgcacaagcttggggaacatccaattcatctaatcattttattctaaagataatgctatttggtatacacattttttcctttattaccttggcacaaaagtgctgcctttagcttcttgctgctttctgaaggttctctcactcagttttaggctccatactttaaccagagcttgcataaagtagagcacaaaagccttttgtgaagcactgtcaccaacatgtcagcctggagtcaaactggctccagggagaaagatggaaacagagtagttccatcaatgagctccaggagcatacattcaaacttctcattattaatctctgtaaaatatttcttcaagaagttgtgcatcacaaaatgcaatataacattcatatcaagtgatacagagatagctttaagcaagacttgttgtactctgtataatgaataatgcaataaaaatacatattcatttccagatcacaaatcatagcaatttaagccatcttctgccttgcagtagtattttgaggggaaaatgtgtgtgtgggccccctctgccttgctcagaggctcattcttctccgggaggaagcctctctgcatgctgtgttgcacagagctcgtttatttccagggctctcttatcagggctctgggggtggtggtgaggccatcatttgaaacacaaccaaggaagcactgctgtgctcatggcacagtaggaaatccgtctatttttaaaatatgagtttgtccaagttctcttgaaacatgttaccctgaatacatcatttcagccctgagcggaacagatggaaaaagtcaaagttgtttcactttttaaagtgagaaagctcattttttgggtcttgaaatactgtttaagtgacttgatggtgggtatcaaataagaagatttcctgggtcaccccagggttggggggcagtgaggaaccctgaatctttttctgtttaccaggggagaaagtacatgccagtggcctctgtctgtgactattatgccttatggccagactttagaggactcagataatctttgagtcttcattggtgttaccattagaagtgttcaaaggatgtcttcctcatccccatggttcccattcacctggtatttcaggctctgttctttttttcttctcagatttgggagaaactctgctaaggatgtgacacgtgtttgctcagttccttcttcctgggcttcagtacaggatctggtatatagttggtgctcaataaatgtctgttaaactggcaagtgaaatgaacagccctatgaggttagtattattactttggtttacagaggagtggtcagagactcagcgaggtgatgtcacttccagggcgtctgtgtggttcaagtccttggctcttacaccctccgtatgccacctctaatggattctcccatttgactctcacgtgtcatggaagtggtttgcaggctgaaactcttgagtgcacagacttagaagtaatgtaaaacactttgaattttacaacagtgattggtccattactgttggcagcttgggagttgtgagcatttcaacattctgagttgaaattcaacctgagaagcgaggtttctgggtgcaaacaatatatagtgcttgcccagaatacctgtttactcagtggagttgggttgttttctctacagaagacctaagagataaactaggtgtgaactggttttcttgccccagttggttccagaactgcctccagagttatttctaatatgtgaatctttgcctgtaagtgacttcttgttgtccacggtgtaaactccaaactatgtcatggcctacaagtcttctgggatgaaccatatgataggccttcctatatccatcccattcctctccctttgtgtagcagccacatggtttacaaagacaagccctccagcttcaaaggtagctcagattggtctaagccaaaaaaaaaaaaaaagaaaaaaaaaaaacccttcctgttgtggtagtcattcattgggatatcccagacctaagtcaactagtccatgtctttctctagccatagcgattggcttataatataaagcccagggctctcattagatggtctcagggtcaggcattctttctttcctggatgttgtttgggaagcatgtaaccttggtagttggcagccaccctgtgagcatgaggaccatccagtattaggatgaagaagacatacaaatgaggaaagagtagaaatgtaaagaaaccagcttttggtgatatgattgagtcatgggaccaaaccagtgctaaacctgaccatgcgggtatttatatttttaaaagttgtaaatttacctgggtccaaaacaataaaacatttttattgtttgggccaattcaagctgcgtttcttgttattatcaactgaaagccttctgattaatatgttactgataatgtagccctgggagtcctttctagatttatctctgccattacctgcatgtgccagtggtgtagcttaaaacactactggccattcttagaaataaactctgtgcattttcacataggccttcagcattctacctctctttctatgttgtaaattccaactcatcctacaaaatccaacccagtatcacctcctctaaaacgatgcctgctctcctttagtctattccaggaagaactaatggcttccttcttagtgtcccccaagtattatctatatacccataatagagcaatttaaagacatttgacaataataatttagcagctctaatagggattgttctgctgttcaatgtactttgcaggtattatcttgtttaacctttatagctgtcctattatactgacattagtatgtcttttaaatataaagacatcttagagacataaagagacttatccaaaggtccacagcttctaagaaggagaagctgagacttaggtcatctaacttcacaatctgtgctcttaaggtctgtgcagtgttctcttccctgcttgtgagttttttgaagtcaaacactatctttcattcatgggtgcctgaacaaatgccctaggcactctgaaaatgctagtagtatacatgaatgaatgaatgaatgaatgaatgaatgaatgaatgaatagatggatggatggatggatggatggatggatggatggatggatttaagcccttcacatcacagatgagaaaaccaggactcaatttaagtgacatgtgttgtaggcaaaagtgcagatgaccactgaaatttttctacaatatcttgccacctttggaagaaaattatatgttctctacaagaaattcccgaaagcaagagggtaaaaataaagctcaaagatgtctggactttttctttctcaccctggaaccagagcatgtccctcttagggttagggttagggttagggtggtaacctgaatgaagcagaacattctcatccccttctccagagttcagggcgtatcttcattttttaactcttttcaaattgctactgacacctaaactaacttggtattaaaagaaaatagagccaaatcacattcaaagtgttctggattgggagtcttatttataactacttagacatcaggtttctaaagaggaaagggggggtgttgagcacaaaattcagaagaacatttgaaattaagaaatagaatcacacgtcatcctaattagccaggagtggagtaaaaattctgcacttctgtcatgttgccaccatgcaagagcaaactgtgacattagtttaattacataaatttatgagatgaaaagaacaacttttataatcattcagacaatactcctattcagtttgctgtgcaatatctttatttaatccttcttaaagtatgtattagattcatttttcaggaagcctcaaacgtatctgtattttaatgacttgagggggcacttttcatttccctcctctgatttctttaaatgggtgtcctcatcgaatgtccatgctccataagcttgtccacctgtgtatatttgacaccaatgcaatcagcatcaccgaaagaaagagcatgagaaaagtcccccagaagtgattctcttggggttgactcacgtcatgagtcataattcttcttcaccattatcatagtagctcccatttattgactatgaacttggtttcatcattgcatttactaagtacagtcatctatcagtatctgtgggggattggttccaggaccttcctcagataccagaatcagcagatgctcaagttcctgacataaaacgatgtagtaggtgcatgtaacctatgcacatccttccatatactttaaatcatctctggactacttctaatcccaaatacaaccctacatattatttcattctcatggattcagtggagtacctggtgtgcagcaaaatcaagttttgcttttggagttttgtgggattatttttctgaatattttccgtctgtggttggttgaattcatggatgagaagcctactgatacagagagttgcctgtagcttcctcaatcatctctaaaactccttggagagtcacagtgcctgtcctgctcacacctccatctaaaggaaactgccccagccccactgcccagggaccacctttgaggtcacacgtgcctgcttctttttttttgttttttttgtgaccgagtctcgctctgttgcccagactggagtgcagtggtgcaatctcggctcactgcaagctccacctcctgggttcacaccattctctcgcctcagcctcccgagtagctgggactacaggtcccgccaccaagacaggctaattttttgtatttttagtagagacggggtttcaccgcgttaaccaggatggtctcgatctcctgacctcatgatccgcccgtctcggcctcccaaagtgctgggattacaggcgtgagccaccgtgcccggcccacacgtgcctgcttctagggttgcaagcttgacctactaacagctgacccacagaccagccaggctgggattttggtgacctaattaaaatattagcttggccaattactttctcttggggattttacctaagtgcaaaaaggccccgctaattttcagtgacagctgaagcagaaaggatagattattaaactgagatttttagcctggggtccacaaacccatttcaaatctttgtgagatttggggtttgtatgtataaatggtatgagcagattcacaaatttgaggtgcaagtcgggtcacacagcttattcactgattacttgctccactccttagcacaagtttcactatcaccctttcaggacccccttacccatgagtaatccaagaactctgaggttccgcggtgctaaggggctccctccagttcccatactcaagccaagaaaactggaaaccgatcaatccaccgctactgacgctccctggtgccatgctgcgtctaggtcaaagcctggtctcctcagtcaacagcagatgtcatcgctgtcctgatggaatgaggcctgtgtggttcctggacggagaactgaaatagtgtcttagagctggcacaagatctcagtgctccagggcaccacaggggctgggtcggtgctcgtcctggtgtctggtgtaatgtggacctggagtcccgtccttttatcttccaggggacaggatctcaaaatgcaaagcatgctatcttccttctccttgtccccatcgcaggaatacctgtgcttcacatacccttttgagtaaaacccaaagtggtaacagggttttctctctcccccgctttctttttttacgtgagtcaaagctttgtgaattcaaggtggatttctgaagcttcactcaccaacgcagggagaaaaaaatgttaaatcaacaacaaagcttgatctttagataagcatttcactacctatgcatttatctgagaagtgggtccctcgttctgatgggatttccaggggcattcatggttcagcaatagatgattaagagagagaaagaatcaagaaccgctactgtagagagagggcccaagggcatccccgaggctgtaagggacagtgtcaggaggtgcctgagagtgaatgaggggagcaagccagcatgctggacagagaggagaaaatgcctggcctgtaactgagttgcatgaagggggtacttgagagagtgccacgcaatgtggctgcgtctcacagacacgtcgtggagagaataaggaataagaactataacattccatttatacaaagcttgaaaacaagcaaaattaacctacaataacataggtgaaaagagttatctgggagggtaccagctgggtagagaaggcagtgctgggcaggctgtctatcagggagagggttactgtttcttaaagggctagctgctgatgattttaggcttggaaactgccaggtctctggggcaactactcacacagtcatagacaagacataaacaataggcgtggtggtgttctgatgaaaccacaaaaccagtagcagaccagatttagcctgtaggcctgagtttgctgactcctgatctatatatctattaatatcttggtgtggggtggtcgttacgttttgtattcatatataaaaattcactgaacttgtgaatttcatgatttagatactttattgtatgtaaattatatctcagttttaaaaaatctattaagagattaagtttaaaacaaaacaacaaaaatctttgtggattccatgtaggtatttcctagaatgaaccaggttctgcaatccagaactcatcagagcctctgctcttgggttttatgaggttgtcagtgtatcctcacaccactctgtctttacttgagccagctggagtgggctttgtggcagagaagccctcccagagctccttaccaccattctgtagggcagcttttaccacccgccatgaacgatggaccaggctcctggggttaaataacctgcccaggatcacatagctcacacagagaatacacagctcccacagctcagtccttccatataactttaaaactctctggacacaagtccatcttcccctgggcagttacagagaagctgcattttctaggattcgattcagcctcacgtcggagttacctcattgctgcctagcctttgcattctcatgttccagctcatcggtgattgtttgttcttggtgctgaacttgacaggagatgaagaaaaacacacagccaaggtcagagagcagcaaactctctcctccattcagtctgttttcatgtttaaactgcaccgattaaagaaaatcatctggacgttttgtccaagcacttggccgggctggtgagggtcatccctgagctccgtcctcccatgtctgtaagcctttgcttacccacatccaatctcactgatcccaggatgaagacagaagagagaaaagggattctgacattagccatcaccattagggtttttcaacatctgaccattaggcaaggtgaaaaagaagaaaagctgtttttctgggcactttgggcctgaagaacttcagctacttaaatcagaagcagaggctttgttgttttggttttgtctctgtcatttagagggctcaacctgtgtcatgaaatgcagcactcttacctttgtattttgcagttaagttgtgagaaaagccctcaagtggccgagaaggttgcttgaaagacgcacgcacctgggtgtctccagtcatactcacacaggaaggagtgagcaatgagggttaaaaccatccccagacgggaccacccccatgtctctttgcctccccatcccctgtgttggtttcccatggctgctgaaacacattatctgagacttcgtggcttaaaactgcagacatttattatcttatagtcttggagtctgatgtgagtgagtctcactgtgctaaaatcaaggtgttggcagggctaccttcctttctggaggccatttcttaccttttctggcttctagcagctgcctgccttttcctgggcttacagcccctttctccatctttgaagacagcaatgttggatctctgcatgcctttcttccgcagtcacatctcccttggaccgacactcctttctcttccatttttaaggactcttgtgattacgtcgggcccatacgcataatccaggataataaagccaaccaattaacttcaattccatctccaagctgattccctgtgccatgtagcctaatgtattcacaggtccagggattaggacatggacatattgtttgcctcctgtccctcatgccccgactcaccagggctggtacccagcctatccaagacacactcattttccctgaacatatatgtgccaaacataaacaacaacaaaaagttgcgtggactccagataggtagttcctagaatgaaccaggttctgcaatccggaacccaacagagcctctgctgctgggtttcatgaggttctcagtgtattctcacatcaccctctgtttacttaagccagcttgagtgggctttgctgcagagatggcatgtatgatgagtttcctgcctatttcagaatcaggattgactaaaatgtttacttactttcattcagcgaaccaaacaacaccagagtttaaggagctcaggttgccacattgcccttattgcagggagacggcgtcttttgcctgtagtcattctcacagttcctgcttgtgtctcacccagaaccctgcctttactgaccacaaattgtccccaaatgcattcgagaaatttctccaatcctatatctaaatttatggttcactaaaggggaatgtgcacatcgcatatgaaatatttgaaatgcttattaattaacatatcacagcctgtgcaaataacacattacattccttgctatttcttcaatgacatttggagtattggtggacagagctacaaatatttttgtctggtctcgcggagacattctatcatggtttaagtacgatggatgatttacacaataaaaccacaaaaccagtaaggaaatgaataggctgacacacatgtgggcactcgtagcatattgagaaatttagcaaagtgattcatggttaagagtttgaaatcaaactgcctgggttcaaattgtagctcttccacctactagctgtgtgccttaagcaagtttgcttacctttctgtgcttcatatttctcctctgcagaatgaagataacaataccacctaagtcatgggcttcttataaaagtgaaattaactaatacatgtaaagtgcttagaaccatgtgtgacacatagtaattactcaaggaatgtcaattcttgttggtgttatcattaacatcattactatgtggtagacacaggaggctcacttggttcaggtcccctgtcctcctggagcctacaggaggaaaaagacagataagtaggtagggaggaagtagccaagggaggaaagaacaagtgcacagaaattgaaatggggatcagggaaggtttcttagaagaggcagaatttaagctgaggctgacgggatacaaagaacttagccagtgtagctagagccagaggtggaggtgggagtgttgtaggagttgggcacaaggtctggaggcctcagtaggatgctacctgtgagttcctactgtgagtaccagtgttgggtgttgtcagggcctcctgggcccacgggagctcctgtgggggcagttgccacctatttctcccttcctcatcgggtcttccctgtattctttgtccacctttttttctttcccttctttgttcctaaagccttggccctgacagcaatctcaggggggacaggttaatggcctctagtctagatacagtcccttgggggtaggaggtgtgcacgggctagattgtcatccttctggtctggggactctatgatcccagatcttaaacaccagactcatctttctctgcgatatcgtttccagtagagcagttctgaaccatcagtcacatggaggctgtgctggtctctctcccatgcatccagcatcctggcaccacttgtcccagaacatgaataaaaactaacttatgtgagtcctgaaactctggcctcagcttgcaagaagagggtgtgttagagaattttaggagcattatagacagcactagcctttctctggtcatcctgacaaagacctcaactctcctgcttttttgtttctgctctaggtttgatctggctttggccattcacttgggtaggggctgtctggagtgctggaagcacatgggctagaatcttgtccgttgtataagttgaacaaatcttagcaggcttagtgtcaactctcagagcactcctttttctcatttggaaaacgggaaaataatactgccttcacacaatgggatgaatccaaagccccgtggccagcgcccagcatagtcagtggtggtggtctgcatctcgtcatgtcctccaggctctgtacatctcatctgccctcccttctcaccctctcttctcttacccactagcagagcccttgcagctaagctgagctacacttttcctgctttctgattaggtggcagctgtctgatctttaactggaacaatcttgcttatagaatctttgtaaattagaaaacaaccaagcagtgcatagcagaacattgagccacaggaccttgagccaaagatctctgtgtcttcggtcgagcaatatgactgttcggtctctaaatttgtgataggacctaagaggacttttgtgaagactaaagtgagctggtatgaaagcttcatgtacagtgtattgttattttatcattacacatgttatatatcattacatacaatgataatgtattttatcattaataactactggctggtttctagatgttgcagaggaagatgattaagtgtcctcactgctgcttcactcccaggagcacagctgtgatcgtgaaacaactctgtcatcaatcggcatcctcagatctgtgctgtccatggtggtagccaccagccatatgtggctgtaaaatttaattatattaaaattctgcttcctcagtcataccagccactacatggcccataggtacaaatggctagtgggtactctattgctcagtacaaatatggaacacttccattatcacagagcattctattggacagctttggaccaaagtataagtcccctcccctcatctctttgaagagttccaggaatgcctgcagtaaattttggggatgctacagagcccacaaagtatatattttaggttagatcatcccaaatacatccttcaaatttactataaataaaaagataaacatcgttgctttgaaaactgttgttagaatgatgaaggcaggggccgggggcagtggctcatgcctgtaatcccaacactttgggaggctgagtcgggcagatcacctgaggtcaggagtttgagaccagcctggccaacatggcaaaaccccgtttctactaaaaatacaaaaattagctagacatggtgcatgcctgtaatcccagctactcaggaggctgagacatgagaattgcttgaaccggtgaggcagaagttgcagtgagctgagattacaccactgccctctagcctggatgactgagcgaggctctatcttaaaaaaacaattataggtgtacgtgtatatatataataaaaataaaaaataaatttagaaaagaatgacagaggctattgacctaaaggaatgctcattacttcttacatatatgccctttttgagacaccagcaggaatttggcacagggagatagtgttatagaaaattattcaatttaaagcagagatcatctggaaaccagaacatgacatttttggctgaaagggtggggagtcttgggggtggaagggggtgggaatggagtcaaccagcaacccagaagcgcgcttggggaagacggtaattggccagctcttacagaagttatcaaagagaacatgagatttgctgtagcctctctgcataagtctaggaccccaagaggagttggagaattactgtgtgtcaccacggggtgtccttcaggaggaaagggcaggcctcaagtcagatgccagatgctataaccatcattatctgcagaggaaaattgggtctgaaatgtccccctggggagcatgctccctcctcgtcttctggctagacgttcctcctgcagggaggcgaggctgaggactgggacaaaaatattgcagttcagtgctgtttcccactagaaaggtcatgggtgcaaaacaatgagtccaatttaagtttgctggtctttaagtatatatattgttattatcattattattgtattgccatagattgtactggtagtatagattgcttaaaagaaaatgaactttgataatcttctgtaatgacaataatacctacctaatactactaataataattaattataagggttaattgagggatgtataataagctcaggcactgagtatggcatgaactgaacacatataaaaatgttagcttgaataataaacactatgcatatttattagaagtaaatattaatgtcttttagcaatcttcataattaattttaatgttttgttaataaattaccaataattcaattttctaataaaatattcatattaataataaaacaataatgtgattaaatacgagttaaatattagtagtattttgttattccataaatgtctatgaggtgttacttgctgtcagactgtgttctaagccctggggtaacaggtgcatgagacaacgccctgatctcaggaagcttatgcttgagcaaggggaaactgcctagtaaaagaattacagatagtgatacatgctaatgagagtaactaagggggtgggggggtgccacaggctatttccttagtggaagcagggaaggcttctctgaggaggggacatttacatggccctctatgatgagaaggagccatgagatgttgtgaggtgatttcaatgctttggacgataagcatcagaaaactctagattcaaataatttaaatgataataacatttactgtttcacattacaagaagtcccaaggtaggaaggttctagggttgtctaactcgggtcccatccacagcacgaggacgcagtttcttccatctttctgcctgcccgtctgcagggcaccctgcagcctgtagccgggcctcagcctggcttccctcatggctgtcaatagttgccaacatcccatctgaaacaacatccagaggaagaagggagaatttccagaagtgtccagcacattgactctcgcatctcactggtcagaaccgggccaaacacccacctttaaaatcacaagcaagagaatagaatcaccatgattggcaagctttttctgtagattgttaaataggaaatattttagacttcacaggtcaagaggcaagattgaaggtattatgtaggtacttaaataataagagagaaaatagatttccacaaagtttttattgatgaaattcaaaatagaatagttgaatataatttttttaaatgcgggcctattaagaagaagaatgagtttcttttggagggaatagcatttttttaatcaggaaaataaaattttgcctaattggaggtaaaagtgttctaacattttatcttttttttttttttttttttttgagacaaagtcttactccgtcgcacatgctggagtccagtggcatgatcttggctcactgcaacgtctgcctcctgggttcaagtgattcttatgcctcagccgcctgagtagctgggattacaggtgcatgccaccacacctggctaatttttgtatttttagtagagatggtctctcaccatgttggcaaggctggtcttgaactcctgtcttgaactcctgactttagatgatctgcccctctcagcctcccaaagtactgggattactgacaagagccactgtgtccagccctaactttttatctaactggggggtcaaagttattttcctatcattaaaaatagattgcaactgttcatatattaatgctgatctatgatgagattttacgtttcatttttgaaaatgtatttacacagaaagatacatgtggcaccactactcatttctactgttgcagtgtgaaagcagccagaggcaaaaagtaaataaataggcataattgtcttccaataaagctttatttatggacactaaaatttgcaattcatatcgttttcatgcacaaaatattattcttttggattttaaaaaatgcatttaaaaatgtaatatgccaggtttgtccctagggccatagtttgcagactcctgctctagactaatcaggatttcccctgagtcatgagaagaaactttgcctgtaaggatcaggctggaaaaagcatgtgagtaagcatgcaacagtgtctacttcaagggaaaagaagtctccaggctgagggaacagccagcgcaaagatcccgaggcagtgataagcctagaaagtatgatccttagccatgagccgggaggaggaggagccgagaggcccgagataagggtggggatcaggtgctaacttccagaatgtggtgtgaggagcaccatagaccctctccctggcaaaatagtaataactggtgaagattattgtaaagaacaaaaaccaaccactgaaatcctctgaaaattgtcctaaggatacgcagcaaataaggaggtatttgagaaaaatctattaaatcctggtaagaacaataagagtctgtggcacttaagccagtacctactctccccttctttccccccgatccccctcagctctgtattgcagggactaccttctaggcaaatattgccaagatgccccggctcccttcctccacccatcccccactcatagcacagagatgctacttcaagtgtggcagcctgagaatactggggcctgattacctttcacccagcttgcttatggggagaagttccatgccaggagagaagtttcatgcccaaaagaccagacgccaccaccccagtccaatgcccttctcataaagccgacgtgctgctccggaagaagtggaccactgtctctgcccccagctctgggcaaaggactcagaaagtttgcccaagaggagaggcaggtcataaggaaagagctcaggagttctctgcagatgaactaactttatttgaaaaagaatgtgtgggtgttaaagctaagaatgttatatttcctagggttacaataacaaattaccacaactttggcttaaaggagcataggtttattctcactggcttcttgatatggtttggctccgcgttcacacccaaatctcatcttgaattgcagttccctaatccccatgtgtcatgggaaggacccggtaggaggtaattgaatcatgggggcagttacctccatgctgttctcatgatagtgagtgagttctcatgagatccgagggttttataaggggcttttcccccttttactcagcacttctccttcctgccatgatgtgaagaaggacatgtttgcttccctttcagccacaattgtaagtttcctgagccctccccagctatatacaactgtgagtcaattgaacctctttcctttataaattacctagtctcaggcagtcctttatagcagcatgagaagggacgaatacacttctggaggccagaggtctgaaatcaaggtgtcagcagggtgtgctccttggaggctctgagggagaatctgttcctggccacttctagcttccagtggctgctcagaatttcttggcattgcttggcttgtggccctgtcactccagtctctgccccaattttcatatgttctctgtgtgtctgtggctaatcactctctgcctgtctttctttgtggtgtgaatctcttctactttatcctacttagagttccttgagtatcttgtatgaataaattcatgtttttcatcaatctggagaatttttcagccattattcttcaaacattctttcttcccctttatctgttcccctctgagacttccaatatgcatctgtatagataaatcagacttcataaaaattaaaaatatttatgctcaaaggatattattatatcaagaaactaaaaagacagcccacagaatggaagagacatttttaaatcatatatctggtaaagaatgtgtatctagaatatataaagaacttttactacttaatgataacaagataaataattcaatttaaatatgggcaaaagatctgattagatgtttatccaaggaagatgatttacaaatggccaattagaacattaaaaaatgctcaatatcattaggtattggaaatagaaatcaaagccatggcatttcacaccaaataggatggttataaccaaaaagcaaaatgaaggtgagaacgtgaagaaatcgtaaccctcctacactgttgatgggagtataaaatggtgcagccactttggaaaaacagcctgaatgttcttcaaaaagttaaacatagagttaccatatgacccagcaatttcccttctaggtttacactacagagaaatgaaaacatgtccacacaaaaacttgttcacaaacgtttctagcagcattgttaataattgccaacagggggaaacaacccaaatgtccatcagcttgtgtatggagagacaaaacatggtgtatccataccatggaatattatgaagtattgatatgtattaaaacatggctgaaacttgaaaacatgacactaactgaaagaagccagtcacaaaaaactaatgtataattcaatttatatgaaatgtctgcaataggcaagtctatagagacagaaagtagattagtcaagggctgtgagatttgaggaaatgaggagtgcatgccgataggtgcagggtttcttttagggtgacagaaatgtattaaaattaattgtgatggtgattccataactctgcgtacatactaaaaccaattgaattgaatgctttaaatgggtaaattggataacatgtgaattgtatctcaataaggctgttgttattaaaaaaaaacaaaaaactgggcatggtggctcacgcctgtaatcccagcactttgggaggccaaagcaggaggatcacctgaggtcgggagtttgagaccagcctggccaacgtaatgaaaccctgtctctactaaaaatacaaaattagccgggtgtggtgatgcatacctgtaatcccagttacttgggagctgaagcaagagaatcacttgagcctgggaggtggaggtttcagtgagctgagactgcgccactgcctgggcaacaagagtgaaactccgtcttaaaaaaagcaaaaaccaaaaaagatgagactggaaaactcatcagagaagggccagccaggtcctcaggggagtgtggttttactttaggtagagcgaaagacatcaggtagagcgaaagacattagagtatccataacttcagccagcctgacctctgccatttgcttttttgtctaaccttgatcatggaagagaaaaccttctgctctcatcagagctattccccaagtcaggttaccccacaacatagagcagcctcatcctttgcgactagatttctctcataagctcctgtacgtcctcaaagaatcctggttcctcaataatggaagttagcagttattctcaaaatgagggagtgtttctaaatgagaatttcctctgtgtgtgtgtaaatagtctcaaacagcttttatatatgaggtctggcagctgccagcaaggaaggaagcaaacatctcattttgcagttaacctgtctcattacgtcattcgttggcagcctttgatgacatttgttctgggaactagacatatgtttttgaaaaggtaaagactcttcctccagatatattgatggcaatgagatcatgacatcagaagctggggttgtaatagtaaaacccagcatcaaaagtttaggccaaaggtcagatgctcaaaagccttcagggccagaaataaaaatagcatgtagctgctttctatcaaggcaggagagagctgtggttactgagaggttgtggctcaaatgcattcaatgaaaactttttagatagtatgttagttaagcctaacccaattggtagacccattggcctccaactggtaagtcatatgatgggcttactgaatcacttttaaccttgagactatttttcagaacacagaattccccaggtctactctcctagtcagagtaaacctgggcagtttcctcaggcagagctctctctatggatgttgacttattttgtttaattaaaagtaataaaccctcctgatccctagattgtctctatatggcaacaggcaataaagatggtgatggtcctgtgtttactatgcatcaggcactgggctaagcactttatatgcttacttcttttaatgctcacaaaacagctaccacaagaaacttgtatttaactgatgaggtaactgaaagtcagagaagttaagtaacttgtctaaaatcacacagctctatagctttcaaaatcctccgaagaaaaattattatttaagaaaaagaaaacctaatcctttagtatcaacttattttgtgggttttagaatgtgccccaagcatttgcatgaatttcagtttaaattttcaatgtatgcccatatatataaacattattttattttattttattttattttattttattttattttattttattttattttattttagacagtatcttgctctgttgcccaaggctggagtgcagtggcatgatcttggctcactgcaacctctgtctcttgggttaaaacaattctcctgcctcagcctcccgagtagctgggactacagtgatatgccaccatacctggctaatttttgtatttttagtagagacagggattcacaatgttggcaaggctggtcgtgaactcctggtctcaagtgatccacacgcctcagcttcccaaagtgctgggattacaggcgtgagccgccacacctggccaaacatttattgaaatgtgcttttaggcagggcacagtggctcactcttgtaatcccagcactttgggaggcggaggtggaaggatcacttgagatcaggagtttgagaccagcctggtcagcgtagtgaagcccccgtctctactaaaaatacaaaaaaattagccagacttggtggcgggcacctgtagtcccagctacttgggaggctgaggcaggagaatcacttgaacccaggagacggaggctgcagtgagccaagatcatgccactgcactccagcctgggtgacggagtgagatttcgtctcaaaacaaaaacaaaagcaaacacacacacacacacacacacacacacacacacacacacacacacacacagaagtgtgctttttaggatggtaaggatagtaaaacaaccaaaaaacaatgaaagatggggcagaataggaattctatcactagaactaaaccagaattttctagatgctggtctaaaacaggggttacgaactatggcatgtggccaaatccagcctgccacctgcttttgtaaataaggttttaagaaaacaccttaaatgatgtattatctatggcagctttcccattacaatggcagagttgggaggttgtgagaaagaatgtatgttccccaaagccaaaaatatttactactgggccctttacaaaaaaaagtgtattaacctttgatctataacaactcatactataaacataatgcacatatcatttccacaaattctataatctcgcctgctgtgtttccccaggttttggccatgaagcaaaccaccaaggccttaatgtaattctcatgttaccccctgaaatgggtaaaggtcttcctcttttcttctaaccgggtagagtgaacctgcatttagagggcccaacctgcttgccagggcacagagccagaagggaaacatggaatcataatgatgccagtgatccccaaacggctcaccttccctgggcttaagctttagcactgtgctcagagccttgcagaaagcatctctgggaatccttgaaactgccttcggggtaattactgttattattcccatctgatagatgagaaactggggcctcaaggaggaaattgcccaagatcacacaaccttcggctgaccccaaagagagtggtgttcatgactatataatgtcatggcatcttgagcgagaactttgccttagggccttcctcagggaagtgttgggctagaaacaacaggcctggctgctgtgaagaaaggagtctcttgtggccacaaaggaagaagaaggaggggtctggagagcctctggatccagggttatttgctaaggctgaagtccgagatccctcttggaccactcgtacctgaattgctcccggcctgctgggtgccaggtggcatggagcttcccagccttcactcagtttgttgactaccaggtgaactcagtttccaactgcaggacatcagaacaagattctgaatgaaaacgtgttcccccaggtgagccatatgcagacgaatgcttgggatgctgggtagatgttgaaaaaaagttttgcccgaagaataccaagtagacacaggctgcgtttcgtggccaacgagagcagtcttgcaaccaggccgtctttctgaaaatgggaatatggtgagtggccaaactttgctctcaaagtagacaatggaagtgttgggaaggagataggaaaggaaaggaaggagacggccaggtttccctggttcttccgtctttagcggtagcccacctagtatgagcactgttcttatgtggtaggctaggtaattccactccctttcccccacatcccccaaaagagatgccataccctaaaccctgggacctaggacgatgttacctacagggcaaagggcattttgcagctatggttaaggttatgggtctgaaagtggaggagattaccctggattatctaggtggacccaatctaatcagataaaaccttgaaggcagaaaatcttccctggctaaatttagagagaggccatcaggtaaggagaggcaggagagattgggggcttgagagggactcggctgtctgtggccggttttcagaactaggggccaggagcttagaagtgcaggtggcctctagcagctgggaataggctgcagctgacagcgaggaaacaaggagttcagccctaaaattataaggaactgaattctgccagcaacgtgaatgagcaagggaacagggtctcctctagagcctccagaaatgagtgcagacagccctgctaacacgttgattttagcctagtgagacctgcgttgtgcctctgccctatagaactgtgagataatatgtttgtggtgtttttagccactaagtttgtagccatttgttatgatagcaataggtaacgaatacatcttatgaatgaaaatgtgctggttagtagctggttagaaagtggcctaggtgggaggaattctgggaggaagaagctggaagagcagcttcattttgagccccttgggaagaacaggaatatacaggttgtattatctaatctcatgacagagttttgcccagagaaaaccaagtagacacataatcttgagacatgttccctgttttcattttatcttgcttactctgtacctacccctaaaacaggaaacagaggacactccaaggggagctttccttgacttgctctcaaaatgtatgtgaaatagcgggacgcctccctgactgtagagaatcagtgccaggaccctagagctttctacttgtgggcatcaaactttttagctacagtagtgtcagactgggaataagcagtggactgtttttgccctgtggtacaatccaggcatctccatttcacaaggtacagctcaagccactaagggtctgagtgcaccatgtgcgcaaaccagaaattctgcagcagtgctggagggagggagtggaggctgtgggtgacttgcttctgtcttcaaatttttgttctcttctcctgtctagtcctcttgagttattaattagaatcattgcctttgtttcttctctgtactgtgcttgtcaggcagtgttccttttccaagaaggggaataaatgtattgtttaatttatgaggatataatactataatagtatattcctttgcctgaaatgtattcttaagtattaccttggtctgtgctttaactgagttggatagagacggcacactgcaattgttaaggttaatgacccagtgatttacaagacaaggcacatttactggcaaatagattttagtaattgttccgctccacagtgagaataacggtttgtgtattgattcatcatgtcttggagttggggctcactcagagaagacagagcccagggtcttgtggcagaggctgcctaggatcgatgagattagcagaccccacaagctcagcttgctaagagaaattttgctcaggaaaaccctcaggtgccctcaggtggagtgaataataattgtaagacaaagatggcttacaagtgctgcaggtgccagaattaaaaaaaaaaaaaataaataaacacacaaaccccacgaaactaatacaggcttatttttttccgcttttattgagatattattagtaaataaaaatggtataatttatgatgtttaacgtgatgttttgatatacatatacattgtaaaattaccacaatcaagctaattaacacatctattacctctcatagctgccatttatgtgtgtgtgattagaacagttgagatctcagcaaatttcaaatatacaatatgttattattaactatagtcgtcaagcttataacttgtaaatgaaagtttatacttcttgaccaacatctcccctttcctctcattctagtccctagtaaccacaattctactctgttaccatgagttctactttttattttatttttttaagcttctacatatgagtaagatcaggcagtatttgcctttctgtgcctggcttatttcacttagcatgacgtcctccaggttcatccttgttgcaaatgtggcaggttttccttcttttcaaaggctgaatcgtattcaattgtgtaaatgtaccatatttatccatcatctgccaatggacgcttaggttgtttccatatcttggctattgtgaataatgctgcaatgaacatgagagcacaaatatcaatataggtttatttttgttctatgagagatgagcacacttgatactcagaacatttccactgggggattcagttcggcatttttaaggggaagggataaataaaacttggggaaaatatcctctagaatggtttgatctcttttaaagaaatataattgtgttcggacccaggatgtaggtccagttatcaggttgattaaacttatttttctgatgccttgcctcagtatggattgagagccacagaatcatctatgagaacctggccactccaagcatatgtcagtaagtctgtgcccttttattttcttgtgcttctctaagactacgggcaagaggctgcaattctttttcaagggcgtctccaattaccgctcattaactctgagaaaagctcaaatagggaagacaaagaggattggactgaggacgctggagagtgaagacaagacactgagctcccccacctcatgcactgcacagggcttctaatctcggcgaccacatgggaatgaggccctgcttcccttaggtctctgctgtccccagggaaagtgagtgagatgagtcaaggcacaagaacagcaagcctccttgtattgcttttccaagtatgctgtttatattgtgcatgtgtatatatgtagatgtgatatatgaatctggagatctcatctgatgggatatgagaaaaaagcccagttgtagaagacagaccagcactgagagatgtcattattaaaagatgaatgaaaggcaacttttctggcggaatgtaatatcacacaaatagacaacacagttttgtttttcttttttaaactctttaaattgtgaaatatcatactttaaaacaagcatttacagtttatatttacagtttaatttagaaaaaaacgtttacctatgtaacaaacctgcacatcctacacatgtatcccagaacttaaaatcagataaattaattaaaaaaaatacaagcacctgtggacccaccacccagtttaagaactagaacatgacccgtgcgttctgttcccagggattctgttctgatatccttccccaggcatgctgtctccctccctccccagcaaggagtacctctgaattttatgtagtcattttgttttaagagatacatatctttacatagctctaaaattgtagagctgtgtgtagcgccagttcattcttttttaacattctgtatagcttttcatcatataaatataccacagttgggttacccacactattgttggtggaaaccagggtcatttccagttttcagcagtgctgtgcatgtcttgtgtcatacatgtacaagagttctctcaggtagatatctaggattgagcttgccagctcacagtttgtatatatgttcagtttttactgcccaatgccaaattgtttcctgaagtggttgtaccgatttttactcccaccagcagtgagtgagagttcccactgcttcatactcttgccaatattggatattgttggatttattatggtttactaactgatggtacaaaggatattttattacaatgttagtttgcaaataaattggtcataagcttgaacaccttctcgtgttggatatatatgtttctttttctgtagaaagcctttctatgaactttttccttttttcttatattgtgttttattctttgttattcactaataggagctcttcacatattctagatccttgctgtccaacagaaatataacgcaagccacatataatttaaaatttcctagtagctacattaaagaagtaaaaataaactaataaaactggttttaataattcattattttatgtcactaaactttatccaaatgtacctaaaattatcaatataaaattattaatgaagtctttgaaatttaatgtgtatgttatactcatggcagatcttattctgtgccagtcacatttcagttgctcaccagccacatgacgactgtattgatcaatacatgtctagaggcttctcctttgacaattagattttcttctaaattgtagcttatgctctcacttttttgtggcttctttttatgtgcaggagtgcttcacttgaacatagccccatttgattaatctttcttagtgcttttttgcattgtgcttaaaaccttctctacactgaggtgatgaaagtgttgtcttttgtccagaagtttgaaagttttgtcttttatgcttacagtcttgatccatatggacttgaactttgggtttcgtttgaggaaatttcaactatctatatggataacacactgctgaactgctccttcttggtccacagctctgcacgtagccctgtcgtgagtcaggtttccacgacaggcacgggtgtgttttcagactctgtcttctgttccatttgtctctttgtttgcctctttccaaataccacactgtcttcattattatagctttaaaataagccctgttacctgctgaggcaagtctcctggcttgtttctctcttggagtttcttggtatatttcagcctttgctttcagatataaattttaaaatcagtttgtcagggtctgtgaaaatccttttgtggccgttctattctgttagatgagctgtgtgaactcaaataagtcactttgcctcttgggcctatcttttcatctgtaaaatgacagtttcattttgataggagtgagtgtttcattattaaatgatgtaatgcatgtaaagttcccagcacagtgcctggcacccaggaaatagtcaacaagtaaaggagtggttttattgctgttaaagctgagatgtgggggcctgttgtggagagtgctagaatctcaaaagacaggctggtttttagttgtacagaactgcagtctaggaactgtagacttattatcacctttgtcttcacattttagtgcaggcttttgtgattaatattaacaatgcacgtgtatagaactttatacctcaaaatattttcactcatttgatcatatttggactgctaaggagcattgagaagcaagtaagcatgcacgtatttggaaatacctgacaagcttcagccaagccttggaagctatattaggacaatggggtaagaggttataaggatcagacaaccactcagctgcctagatgccatccatctgccaagacaatttgaaggtggaagggagggtaggattgccagagaaaaacaggacattcatctaaatttggatctccaataaacagtcattttttaggataaatatgtcccacatattgcaggtatacttacactgtgacattcatttctctgaaattcagatttaactgggcatctgtgttttcactggacacctaaatctggcagaaggtattgctgttacttcttcaaattggaactgtgctccagagtcttaatgcataaattgccctgagatctcatgcagtccagctccttcttttagcaaatgtggaaattgagatccagaggctgagtggttacgtgtggaatcggatgattcctgattctgcattcctttttatgcttctgaacgtgcaaaaatacacagccaccttttcattgtcttctttatcttggagaggtagggacgtctaccacattgaccacaactcttcattgagccttggttatgggcagtttacatggcaggccctagccaccaggcaagtatctggtcactcaggggattagctaggtctcaaattctcagggttctggaagtatcattctggactgtagctgaaggccatgaggccacatagccaggctttagcacctccattgaaatgcagccttgtcagagccgtcagctcctgtgctgatagggaacaatcacagagaagcaggcaaaagcacaaaactcttcagatgaaaaagaataaaaaatgatgaaggggaaggaaagagtaactgatgagaaaagatactgccacttctgacaactggaggggctgaagggcctaaatgcagggaaaaagaggggttccactgggagaggcaagtggtacaacaagatttcatatcagaatattttttctaaaatgaggactcttagactgagaaaggactcccatgggcctcttagattgatgaagagtcccgttgctggagtcattttaaaccagaactgaacaaagtgattgaaaataaactgcagggaacacttgcttggatatcttctgggacagacttgatcatctgatcagtttcttccttccctcaatgcctgtgaatcactggttcatttgaaaacatgatagttaaaactctcgtggaaccagaacttgagcatttaattgaaagtaattttcatacaagtgaggcatggtctagaaattcatttgttgtgtgtgtatgtaatttttttttaagtccgagataaggcgagcaactagtttcagaatccttactgggccaaagctttgtttcaatcttgttatgctcttactatttctaacctctagttgcaaattatttttatgtgacacttatgtccatttgacttcatttttctaactaaatagcttttcaggaaatagatctcctgacttatttcagagctctaaataaatatccagagtatctgtgtactataaaaacattataaaaactcctctatggtgctgatccaaggcatgaaaattgccctcctggtgttctatgccaagcctggttgaccttcccaatttttctgctacaaatctgaaaaacaagctcagctgtctggagaaacatcaggcataggcatacattagataaatgtttgtgttttcctttcatcacggacgacctcgtaggagatgaatgacataaacactctacctgttagtagacttggattgctgtcacattatttcctgcatcagttctaatactcctggaaatagatgtttttaaaggcaatttgggcagcagttattatcttttgctttgcatcttgcttaccctccatgcaatgactgactaaatattgttgattttactctttctcccgtaatcctctcccctgcatccccacctctctagccccactggcactgcctacggcctccctacctcccatctccctgctgtctattgtatatgctgcagctacgtttagcttcccagagcagagccttgatcctatcgctctcctgctcaaaacctgtccatagctccctgttttctatgaggctttcccaaacattagtcataccacctccattatctttgctattttccctttccatctgtgctgtggtttacttcatatttatctttaaataggctcacttaaaaaaaaatcttaaatgtattctaaagggaaactttatctctaagtaaatggaaaaccagtaccatctatcataatagaaactataaaaataaatgcaatgaaaacaaaagtattatcttccagcaagatagtgttgcctgaggctcaaagcctgaagcctgatttctctgtgtttacaaaggtgggtgatgattcagtgactgtttgtccctccagatctatttttctctcttcttcttgttgtctgcccaggaggctgagcccgaggacaggtcagtgagttcccttactttctggtttccagctggcctcagcctatggcagcccagcagagtctaggaaggagggaacgatgggtccagggctttgttccctgcctctctccctgcagggtcaccacagcctggcagtatcccctgacaaaagattgctgcccattttaacatggcttgttcttaaaccctccccttgtcccttcaagcctggaaatggtgacagctctccctttacaagccctgggtcagtgtgttgcccttgtggttcccctgtacccatacttagctgattgtccctttatgacacccacttggattatcctgctttgataggtcatacctctcctgtggagaccctgactagtataattatcatggattagttgttatagatagacccacatcaactgagactttctccttggcttcatcaaagattgaaggggaattgataggtaggcggtctctgtaccaccttgcaccatgcatgtacaccagtgagtaacacgtgtgttccccaatctggagaatatctttctatggaataaaccccaccattctttgtgtaggattcaagctggactggagtgccactcaactttcccatcctatttccttccacacactcttgcttaccgacaaataaccatgctatttcctgttcttgccccgtaatttcccaactttcgtctgtatttagaccatttattctgcttagaaagaatacctcctccatctcctcattaaatctggtcacggttctgatgttgccttctccctgaagccaacactaatatgcttggcactcttaatattgtcttgacctcccccaaactctgggtatcattccctccatgtctcccatggggtgcagggtggcagagggtcagacttgcccaggcccctggctgagcctcaccttggaaccttgcacatagacctttggcctctttctttttgagatggagtcttgctctgttgccaggagtgcaatggcacaatcttgggtcactgcaactacagcctcctgggtttgagtgattcccctgcctcagcctcccaagtagctgggactacaggtgcgtgccaccacacctggctaattttcttgtatttttagtagagacgaggtttcaccacggtggccaggatggtctcgatctcctgaccttgtgatccgccccccttggcctcccaaagtgctgggattacaggcatgagccactgtgcccagtgacctttggcctctttaatccatctctgacaccccatggcccttactctgtggaggtcatcctgttctagcttgttttataatcgtgacttttctcttggattataccaaagccccacgcattcatttattcatttaacacataatgattaaacctacaaagtactgggtgcatgctaggtgctgaatagatagtgatacacgaaataacctgattcctaggcccagggagcttactacctgaagaaaactatagaaaccctttgagactacacccttttcaagagaggtatgagctcgagagtccccatcaataatttacttgcacacacacataattgtatagcagccactggtttacagtttgtgatgaaagtgccctagttgttaagaacatccttccctgggagatggcctccgtgaggggcagtagaggagaatggttaaaaggcaagtcaggctgtactcacagctctgatcattcactttcagcaaacacagcacttctgagccttaatttccttagctgtaaaatgggtttgttctctccatatacttttctcagaggtttgtgaggagtcaaaatactgcctacaaaggtttgtaatggtgcccatcacaaaataagtgctcagtatgtatcagtggtggttgtgaggggagtggctatcagcttatggaagtctagacattggatctctaaatacaggcaagattcgtatttgcttgggaccatctaggttcaactcacacggaaaatcttccaggtgccagggctgtgattgtaaacaagctggaaggaaaatacacagtaaacacaccagaggaggagctgtggaaggagctggaaggggttccgagcaaacagggactgccacagcctgaggacaagtccaccccagaaactcatatgtacgctctactaagattctgttcttgaaacattttcttgtctagaaacacagaggattatgtaggttctcaacagatgtttactgcattgagtccattgtgtgtgcataacaccacagacccaatttagggatggtggttgttgtaagctttattaaaaataggctatcattcctgccttaagacaatttccagcaggcacattaatgtgactcatctttttatcttgatcaaaggcaggtaatttataacccaggggacattgtagaagtaactactatttttaaaattaccagagggcagaaaagtattagttggtgggattgctttgggtctttcatcttgggtgactagatataccttcatttcaaggggaggagggtggagaggacaagaagagtccctattctggctttccagaaagagcctgtcttcatggaagcccatggctatactttgtgctgcccctttgtaagagggagagactgaatttcctcaataaaaatcacagctgcctctttaaacatctactttgtgtgagcagaattgaacagatagtatatgacttattagctctttctgacaagaaccatctgatgtaggtacagttttcccctttaacaccctaagaccctgaggcctagagagttcaagttctttgcccaaggtcacccaacggatgaatagtgcaggtggaatccagatccaggtctacttgccacccaagctcactttttatgctatctcacctgcctctccagacacttctatggaaggtatttggttaggttgatttgacattgtaagtatctaatcacatattccctggaattctctattcactgccacttagaacaatgactattattctcaagatacttgaggccccctgctgtaccctaaagagtcctataaaacattaacaagcaatcaatgagaaaatttgcatgtttcagtacaagaaagggctctgaatctcttgtcatcactctgctgtatctcagcactgtccatgtttgtttttatatttgttcgtctgttcaccaaccacctctccaactagacggtaaactccatgaggcaggaaccaaaactgtggtgttcacctgtctatactgggtgtgcctagcaataaacattttctgaataaataaattctctctgaatgggtaatccccacgtaatgcgcatggtttaagtctatttaccagaatttttgagcaaatagttctatcctttttgacacattttccacagtttgtataatttattcatagaatccttcttagactactaataaattcctatgggacatagtccttttatatgcggaggaatccaccaccatgaaatgttcacaagaaatgacttttaaaattttatttgtggccatgctgattatgaatttctgaattatgtctgggctgctctttttctcggaatatgcaaagtgggatactggcatctctgtatctggagagttacagcttctgagttaaaagatgaatgggaagtagcaggagagggagagatcagaaatctccactccctgaaacacagacacttcacatacccaggaggtaaattcctggcatgaattgtaacaagtatacacaggcatttgtacattgtttgcttatgtgctagatgacatggcagtctatgaacaggggccccacatctgcaggcaggacattcagccctgtatcttgccactaccatgaaatctgaggttctttcatttttgtttttctattctgatgagattgaggtacactgactcactggtaaagaagacaatttatttgtgaacttgtagtcactccatttgacggcctccctctactcactgaggcacagcacgtgtggaacaggaaaaaggcctctggagagcttgtgttccactggtttctttgacttttgccaaccaactttgcaaatgttctcaaaaggcattcattacctctgcaggtgtgaaataactctgcagttcaagggtttgtgaaatcacgtgaaacagctgaaagctgttctggcaaagcgaccagagtcagagttagctgtcaccaagccacatcctggcttaaacgatgttatttatatctaactgcactcgactcctcccaaagccttctgttgagcaccaaaacctcaccacagtttcactcttagcctttcttttgtgtgaagacaaaaaaggttgcttttataaatctctgtttgagcccagatggagtgcatttcatgcaggaaaatgttgcttatagtgaagtggatgaaataattgctgggatttctgggcatgctccacaaacccagaagactggaggtgaacgggcagggagaagagattccgttgctttctcattcctttatttgtgactctccctggaaagaggaaaatgtaggcatatgtagatcaatgtgtcattacaaaggctcagtgttcttagtcataaaatgggaggaagaacagtacccacttcccagaattggtgaggacccctgaacgggtgcatgccagcttctcgcacagccctaccaggtaatgagctccactgtgtagccatcactactcagagttaatccgtgaaagagtgtgtgggaggaggataggccttagattccaaagggtggaaatcagtggaaagaggcaggatctgatcatgcctagaccagatgcttccaagccaggcaggcaatagatggttaaaagccaaaatgcctgcccctttggtgaaggttctcattggtctaaggcatcctggccaactgacacatgatatcatgtaacgtgttttcctggggcccagaagcttctatgtgcagcttctttaaagaccaaaactgcaagactttgagttttgatatctcaatatgattttgaaaaaatcatggtaaaatatatataacataaaatttaccatttctaagtgtacagttcaggggtgttaagtatgtttgcattgttgtgtacccaaccacctgaactcttcatcatgtaaaactaaagctctgtatccattacgtaagtccttatttcccctggttgccagggagcccctgacaaccacatcagtttgctttttgatgaccttattatttgttttatatatttttgtgatttgtgtttgtgggagtttttaaacaggggtggggtggaggtagatctagaacttatgtattttagtgacctaaatatgaaatctttctagagtggcaaatagagatatttatttctcatgtctgccctggaaatagaattaatttgccatttcagaaatgaaccacactgcttttgtcagacttttcaacctcattcccacattggaaggctatatggcttgctggtgagataacagccatggttcggctgaatcactgcattaatgattctaaaatattcccatctaatcccctgtagctgaagaggataaacacatactggcaaggacttgacagtatggggactagcaataggcagtttgtcaaatgcaaaaatggtttggaagggtcaaggtttagctaaaaaaaaattcgggcaaacttttcatttatccatgtttcctttaatatttatattaaaattgtttagttacccttcaaacacataaaacttgtaagtaaaatggagtctgtaagacgatctatattgtccacattttcactgactcccagtataccaatataaaatataacatatttgaaatcttaaattattaatcacctttttacccatgttcagattaactgggtaatctaaaaataggagggagtaccttatgtgcaatttttggggaagttcaggagcatgctcttgaagaattgctgataaagtgtgtaattgtcccatgaccaccatcacatcccaggggagagccttatgtttggttaataaaagaaggcaggatctggtctctttttaaaaagactccagccttaattatgattcatttatttaaagatagcccctgccacctagtcttatcttggctctgaaaataaacaaatatcacatgcttccaacaggaaaaggtttgaatgacctttataaggcaatttacctttgactagataagaagagatgtgcattgtactttccaaccacagaggtaaatttccagccctcctccagtgtacaggatgaagtaacactaattctacctaagataacattcttcattgaacacatatatacagatgtcctactatatattaggtgctaggactatagcactatcaacaaactattctatcaaggccttggtctgataagattcacattcttgggtgggaaaaatatggcaaaaaagtgaatacataaaataattttaaagactgatatgtgcaacaaagaaaatatatcccaagggtatgactgagtttgcctgctttaattgggtggtcaaggatagcctttctgaggcggtgacatttaaatgatctttacaacaagaagaagccatcatgtgaatatgagggagaaaagatttctagacagagggaactactcatgcaaaggccttgaaatagaaccagcttgttttgttgttttgttttgagaagccaagagagtggcaatacagttaaatcttgaagaggaagggcttgtgaactcagggcagaagagagatagacagaggccggaacatgtgggatcccaaggcaaaaagtttggcattcataccaacagcaatgggaaacccttaacggagtttgagcaagagaggcatgatgtgaagtctttgagatgaccatactgctagctctgtaaaaacagacttcgggagtcatttggaagactcttacacttgtccaggtgtaagaaatcctggcttagactaaggtggccacagtgagaagggaaggaaatggcagagctcaggatttaacagtagaactatgatggttaatttcatgttaacttgggtgggccacagtgccaagatatttggccatccattatctgagatgattctgtgaaagtggttttttggatgagatttatttttaaatgggtaggctttaagcaaagtagattatcctccataacgtgggtgggtgtcatccaatcagttggtttccttattagagcaaaaactgaccgacctcctctgagcaaaaagaaattctgccagcaaactgcctttggatttgagctacaactctatcctggggctccagcctgctggcctaacctgccttgcacctttagaattgcatgaaccaattaattaaattatctctctctcgttctctttctcctctccctgtcccatctccccctgcccctctgtatgcacatacatcctgttggttctgtttctctggagaaccttgggattcactgatggatcagaaagagaggaatcaagtaatgcccagggcactgtccagtagaaacagaatacaagcgatatatatatatgtataaaaagaactttaagtctttttagcagccacattaaaaactgtacaaataaacaggtaaagtttttataacatacagtattttactacaccaatatatctaaaaatgttatttcagtatataatccataggaaaattattcctaagacttttacattctttttatcatactaagtctttgaaactcagtgtatattttacacttaaagcctttctcaattcaggccagccccattctgaagcgctcactagccaatgttttgggcggtacaggtctggttggcctcctagctgagcatacaagaacctagcaggtgttctgaccaggcttgaacccttttatgcagcagtttccctctgaacaggcaggaaggctgttctttttgtctcaaaaggcagaactgtgaaaactgctattctccctttggtgacctccatataaaaagtttcatgactgtctgtgaagccggtgggcccatagctatgactctgcccttacaagggctaggcttcctcactcagaaggtcattcagaagatgaggtcttggagtctctttcatctatgtcttctctggagtctcggtgtttgtgagacatctcttgccccagagccggtagcgggcaaccagtatcaatataaaaagaaacacaagtagactatgtttttaagccaaacgaaggcaaatgactccataggattttgtaaacagagagttggtttgaacatgccaaactcactagaacagacaagtagtaggcattcacagtgcgagtggctatttcatttaacaaaacatcatgtttcattaattaatgttaattacattggtttggtaggtttgctaatttctaatttgtgttctttgtgatgatataacagcagataatatcattatatttttatattatctaggtctctgtaaaattagctgacattgggagtccatgagacagttcttccttttaaagggggtctttaaatgtacccactcaactaactttaccaacggttcaaagtggaaaatagttcccagaagctgaatgggtagatgcccattgtaccacctaccattgcttgacccccgcccatgagctgttccttcatactcataactaaaatgccaaatgtgtgacttgagtaattaactagagacctccagaaggctttccttcttattctgggtacattgatatttactttagtatttgttttgcctttaaagtcatgttcccttttgattctttaatatcatatccaaaacgaagtccttttaacctataacaatgcaaatcaaaagtgctgtctttcagctacctcaaggatttagcaagcgttcctggaaatctaaccaaccttttaaaaagtatttctatgggaatgtatttctgagccctaaattatggattttgaaactaaaatagaagaatactgtaagtgcaaaacttccagtagataacagaatttgcaaaatctctaatctcttgtatgtgccccaagtagtactctctataggccattggaacagaacatctggcttaaaataatctcagcaccaaaaacggtctaactatggtctccacaacataacccgatggttctcatattttagatgcttgatgcacaagttgaactggctaacaattcagacttcaggacttgactcccctgggaatctgcagttgtttccctccccttgagtgagactgactgttgggagtagaataaccgcatgctctgggtcagaatgcctggcccttcagagtaacggcagccatgatcgctgagctcctactgtgaggcacatacttcgccacactaacacatggaatccttgcaagctccttacataatcagtattttatgcactttgcaaatgagaatactaaggctcagaagaggcaagctcctctcccactgttaaacagctagtgatgaacagagctgggacctaaacttgtctgatttcccacactgctgctccatcagattgtttgccaggttaaggattcatgccaggaccttaaatccctctgaatcgacagagctaacctaaagggcaccttgatttcaggttttgttcccaaacctatgactgtggcctggccacgtaatgaagacccggttggttctagcttcacaatgagctcattggcattgtccccacaaccaccaccccctctccacctctgatcatccactatcatttctatatggcctttgccaggcttgtcctcatatcaaagcttctgccctctatgtttaaatgcataagcttgacaaatgttttcatttgagaaggcaagctgcctccccgtgcttggtctaatgtgagcttggtagagtgacactgctggattcagttttagtcatcaacacttccagctgatgctgatctgagtaattgtcctatttagactctgacaggtgaaagtcatagattcaggaaacggagactcccctcaccctgctatgaaggggagtttgagagggttgggcagctcttcccggcagtggcaggcagtgtggggacacacgtatggataaattgttaatgctcttgaaattacccctattagatgagacctaaagaagcctaactaggcatcactctagtgctgctaggaatcatgttatctggtctgctggcaactcacattgaataataagtggatgtgtctcaagatgcctatctgtaaataagatgaacatccaaccatgaatataagccataaagatctagaggcaaatttacaaaatacactcatctaaaattaagccaatgacagggaggtatctttgagaagtgtcccatgttgtgatggttaactttgtatgtcaagttgactgggccacagggtgcccagattaaacattatttctaggtgtgtctgtgaggatgtttccagataagattagcatttgaattggtagactcaataaaatagatgatcttccccaatatgggtgggcatcatccagtccgctgggggcctgaatagaacaaacggcagaggaaagggagaaattcactcctttttttctacctcattgcttgagtgtctcatctcatcttcccttatcctcagactgggatttataccattggctgccatggctctctagtgtgtggacttggactgaattacatcaccagctttcctgagtctcaaggttgcagacaatagtttctgggacttctcagcctccatggtatacatcaattcttcataataaatctccatatgtatctctctagaacgatctataagcctatgttagttatatctgtatatctctgtctgtacctctatcctattggctgtgttctctggagaagcctgatgcacgtgtgttatcaatccctgccctgtgaatagaatctgcaggtggctgatatgtttgcatggccatctttttatctagtaatgatcaatctgagtaacagtgaagatctgctggggaaagagatgggggaggaggggagacaggtaaattagtggtatatttgttgtgattcaggtgttataataatgcagcattcaacttattgctctaattgtatttaaactgagataagaccaaacctcaaccatgtggcattttctcacattcataggtttaatgttaacttcaaaaagtaaaagtggtataccatgtaacttcaagcaatgctcccaaccatagccaagaactgcagattcttggctatgaataataattcacaataatactatgactttcagagtatttgactgaagaacctagggatttatgacagcatatttttctccattctcaacagtaagctgtttgctcaattattgaacaccttcacaagagaaatcaaacctcctgagtttcagataaatctagttactcttcacgttagacacatgaacctcttccacttgatttgattcttccttttctgcatcagttattcagttcctctgctgaaattccctttatcatatgactcacttactattgtccctcttattttctaataatctgttgcaattcatcagcgccttttccttttttttttttttttaacttttatgttaagttgaggggtacaagtgcaggtttgttacacaggtaaactcttgtcggggggatttgttgtatagattatttcagcacccaggtattaagcctagttctcattagttatttttcctaatcctctccctcctcccactctccaccctccaaaaagccccagtgtctgttgttccccactatatgtctatgtgctttcatcatccagctcccacttttaagtgagaacatgcggtatttggttttctgttcctgtgttagtttgctaaggataatggcctccagctcaatgggccatgaaactaggccggtgttataaaccatactttcccaggagttcttattgaggagaaagagacatgacttactgcgtgcacagtgacacaggggagtctgtgctgagtgctctcattgaggaacaacaggcaacagagtgtctgaagttataggagaaacatctcaatccaccagcctccatgcattttcctcaatttttatttatattaataactgcaacttactccttgctgggaaagtgacagtagtcttgcatcttctctcatcaagcctaccccaatcaccttaatccttgctattcaatatgtagtctgaggatctgcaaaaacattatcacttgataacctgttagaaatgcagaatctcaggcctcattccagagctattaatgcggaacctgactttaataatcaccaggtgacccataatcctgttaaattttgagaagtgctcctctggagaacttgcatcgatggcagaaggttgcaattaactgaagagcaaaaattcacacttacctatgtcctgagactattccatgagtttattaaatgagtggactagacagtgttaccctaggaggtcactactaattcctcactagctgagtgacatagtattcatgggagccaggtgagtaacagtgcagttggtatgaggtggaagggtccattcgattacttcttagaatgaaaatagaggccaatcctcctctgtggacgtagagaaaaagggctagctgatccaaaggcggatagtagatgtgcctaatactgctatttcttggacatagcagaaaacacatagttttgctactgttgactaagagtgtcctaccttaatcattggttatataggcaagcagttaatctgggtatggttttctttcttaaataagatatctttctcctctccactcttactccttgaaactcacatacactttttgaccactaccacgtgctatgtgctggtgacataaatgcaaaagatgtggcccagccctatagcacttctaccaatgcagtaaatatttcagtttacaactttatcaagtacaatatgaaaatgaaggctgctgtgggcttatgtctccgtctttgcagcattccttccttttcctgtttctccctcattctatatgatgctgatgggaccaccattatgtggtctcactcactccatggcagaaggaggcacaggacccaggctggtaggtttgaacccaatcctcttggacagagtgattgatctagggatggacatgatacctaagcagagacaatccacatctttatcaaagagtgatatggactctgagggagtgtgtgtattagtccattctcacactgctaaaaagaaatacctaggcaataccattcaggccataggcatgggcaaggacttcatgactaaaacaccaaaagtaatggcaacaaaagccaaaattgacaaatcggatctaattaaactaaagagcttctgcacagcaaaagaaactaccatcagagtgaacaggcaacctacagaatgggagaaaatttttacaatctacccatctgacaaagggctaatatccagaatctacaaataactcaaacaaatttacaagaaaaaaatcaaccccatcaaaaagtgggcgaagggtatgaacagacacttctcaaaagaagacatctatgcagccaacagacacatgaaaaaacgatcatcatcactggccatcagagaaatgcaaatcaaaaccgcaatgagataccatctcacaccagttagaatggcgatcattaaaaagtcaggaaacaacaggtgctggagaggatgtagagaaataggaacgcttttacactgttggtgggactgtaaactagttcaaccattgtggaagacagtgtggcaactcctcaaggatctagaattagaaataccatttgacccagccatcccattactgggtatatacccaaaggattataaatcatgctgctataaagacacatgcacatgtttgtttattgtagcactattcacaatagcaaagacttggaaccaagccaaatgtccaacaatgatagactggattaagagaatgtggcacatatacaccatggaatactatgcagccataaaaaaggatgagttcatgtcctttgtagggacatggatgaagctggaaaccatcattctcagcaaactattgcaaggacagaaaaccaaacactgcatgttctcactcataggtgggaattgaacaatgagaacacttggacacagggtggggaacatgacacactggggcctgtcatggggttgggggagtggggagggttagcataatgagatatatctaatgtaaatgacgagttaatgggtacagcacaccaacatggcacatgtatacataggtaacaaacctgcacattgtgcacatgtaccatagaacttaaagtataataataaagaatatctgagactgggtaacttataaagaaaagaggtttaattagctcatggttctgcaggctgtacaggaagcgtagcagcttctgcttttagggaggcctcagaaaacttacaatcatgacagaaggcaaaggggggaagcaagcacattttcacatggccagagcaggaggaagaatcagtaggggaggcattacacacttttaaacaactagttcttgacttaactcgctctcaccatgatagcataaggtggatggtgttaaaccatgagaaattgcccccatgatccaattgtctcccatcaggccccacctccaacattggggttataattcaacatgagatttgggtggggacacagatccaaactgtatcagtgagcatcatgttttatctcttgggatcaaaagcctagaaggccatgcaagtctacagctgttgtatctgtgtttcctgccatgtaaagataaccttgctgaatttgaagtcaagtagaaggaagcagaactaagagaggggatacagaactctacacctgaagatcccacctcccattcccacatctgagtcaatagattgctatttttgctttgctttgttttttgtttatgttttgctaaattagagttaggtttctgtcacgggccactgatgaatggaggccccactgaaaatgtgggaatccatgaatctggaaggacatgatggtgcccatctaaacatgccagacaaggaagatgggtgctggcaggggcaggcatggtggggcaatctgtgtgcctctgactgaactctgggcatttcttcctgggaaccaactgatggaaagaccatggggcatggagtgagagaaataaaagttcattctcaactcagtcattttcttggtgtatggccttgagtagttactgcacatttatggaacacctacctcatgcatcattgggaggactcaattaaatcatgtaaggccccatgcacttctaatatatacagcatctaaatgtttacttcctaatttattccataaaggattgaagcttttaatataaaaacatactttacaaaatgattaagaaatatagacacttaaagatgatcatgggctggaaatatataaattagaggaaaagtttatgatggggggaggaataacactaacaaggcaagatctcaggatctgtgatattgttaactgtttcaagcttggttttgagccttccggaagccaaagggaaaaggggggaaatattcatatacttctcaatgtcaaaatgaaataaacatactctttttttccaaagaagtacagaaatatataataaattgcaaatgtagccttcaaacaggagagtcactggtggtataatagacaacatctttctacaaatacaacagtaacaatgggtgtctgatttctttaatcatcctttgatgtaaaccaaatatgtagttttaatgcccatcttagaaaagcagagtctatgaacccaaatagatgggtagatggaatttgaaagctctagaataggcagagaagcttctcaaaggctacccccgattatccgtaatagctgaagagaatgaaagtatactgctgttggggcttagcaaacgatatccccaaatgaaggcttcggcagaagcctcagaggcaaacgtttttctctgccctcctgtctcacagacttattctccccacaaggctagccatagaaactagactctgtcctccccatcatgagccacagaaacccaagccccttttcactaaagccagccataaaaaactaaaaatactactctaattttccctctaattttgtacagcttttctgtacaaaagctggccataaatcatctgccccaccttgtttgactgtaggtcacaaggcccctattccagagagggtcctgccccacacccagaaggaaggaatgctgctcagaaagaccaagaagaatctagacagacagccttgctgggtttccccactcagcctattagcattagatcatagccttttcctccaatcatatttccacacatactgtccataatttgttgaacctaaacataaaatggacaattttctctgtttctttgggtctttattctgaaggaccctgtgtatacacattaaataaatgtgtatgcctattcttgtattaatctgccttttgagttgatttttcagtgaaccttcagagggccaagtttcctttggcccctacactgcttaaacctcattgaatcctgtgttgtaattcaaaacaaatggcaattttccactactttatctactgggtcttcccctaaatcttctggttagactgaggtttaagaagatatttcatgtttgtcctgagggtctgcacaccgctgggatactgtcacctatctctaggtgcttccctagttgaagattctctcatattctacatatcagactccccccaggtccctccttgcaggctacttaaggaaacctcatatgatcattaacgaagacccacgggaatgttaaaaagtttggtgtaaattctttggggttttaaaatggcacctttatgtctgtgcctttaaagatcctggaggatttaattccttggggaattccagtgaattgttctgacttgtaccaactgtctcagacgcaaagatgtgcagactcctgtgcggaggctcagctctgcctgtagacaccattgttacacacacagaaaatcagctccagggttgtctctcgcttcagaaaaatggcacactccatttgttatcagatgcctctgacttcagtgatttgaaagggaactcttgtgttgtccggaaaattaactatctcagctacactttcttcctgcagaagaacacttcttatggaattacgtgattattttgataccgcttggctttgaaagaagagttaaagtagaaagtcagcataacccatctaggcatggagagaggggaagtggcatagctgaagaacctacagaaaaatgagaaaaaaaagagaaaagattaataactatgatcggggcaaaactatcaacacaggagtgggttttgtttggtttgttgtttttttgtttttgttttttgttttttttttaccattccccagccctattaaacaaaccccagaaacttttattcttggtggcccaattttccttctctcaactaagtccagttgttatttgttttttgctgatccattatgtaggccaagcttgtccaacccgcagcccacgtgctccaagtgacccaagatggctttgaaggtggcccaacacaaattcataaatattttaaaaacattattgaggcaggagaatagggtctggagacagagaacttaaggccaatttgtgctgacttcctaaaagagaaacatcaaggtctgggggcaggaaacctaaggcctattaacaccaacttcctaaagctgaacctaaaggaaaaactccatctccccggcagaatagcaaaggatcaaaggctactttccttacagccctctcactctaccatgtctcagatggaaagggagagtgccttgggttcgcagggccaagcagagaccatccctttatctgcatagggcaccaattcacctcagcctttaattagccacataccaaatccttcatcgggatagctgataagaacctcaaatgggataaagtccagaaaactttgtaactgggcccttaagccgcttgctggggcccattcccaccctgtggagtgctttctcactttcataaattcccgcttttgctgcttcgttcctgcatatcattcctctctactttgtgtgtggtgttcaatactttgttcaaaatgccaaggacctggacaacttgtagtcaagacacttcaccagtaatatgagattttgggggacttttttattttagctcatcagctatcgttagtgttaatgtattttatgtgtggcccaagacagttcttccaatgtggcccagggaagccaaaagattggacacccttgatgtagacttttgtgatgcagaagttgggaactgaatgtgtgtgcaatacagaaacacatgtgtataggtatatatccacctatatgtatacatgcctggtatatacaagtgtgtcagcacatatgtgtaatacatatgtgtgtttccatgtagatcttggtgtgtctgtttctcaggatcatgtggcctagagattggagaacatttccatggaaagataagaaagggatttggggaggttctggagtaattgtggagtttataaattagagagactgaatcacatgtggccctgcactatattcagtttacaaaaacatgagttaaccttccctcgtcctccaacatctatccccttcccaagcatgctgccttcgttttacttcattagttcatatgattggtgggtgggacatcagggaatgggaaaatttctttttagaacccaaacaagttgaagttgatttcctaaaaacaaatttctggctgggcgtggtggctcacacctgtaatcccagcactttgggaggctgagatgggcagatcatctaaggtcaggggttcaagaccaacctggccaatgtggtgaaactacgtctctgctaaaaatacaaaaaaatagctgggtgtagtggcatgcacttgtaatcccagctactcgaaaggctgaggcgggataatcgtttgaacctgggaggcagaggttacagtgagctgagatcacaccacggcactccagcctgggtgacagagcaaagctccgttacaaacaaaaccgaatttctttattggcattcccaaagatgcaaccaagaagagacactattagactattagagagagacaggaaaatgaagcagcttatccaatagctccctgcttatggggattcatgagaatattttccttccatttcctatccccatttcaaaggaaggggccaaagagaatgggcttagagactaaacatttgtgttggaagtaagcatgaagattctagattaggaaatcattttgcatgtgtcgtcatttgcatgggttttccttttggctttgttcctgatttgaatgtagtctgtaaaaggagcgatatgccttttttcgtatgtgtgtacatgcatcatttactcagtatctcaatcctggtatttcatcaggagtgggatgtcaagtaaattatattttatccctaggatgacaatgactgctttctaatagcaggtctgtgacctggtcctagacctgaacactgagaattttgttgagtcattaaaactagattttatagatcttcaagaattatttatgaaagaacttgatagattagaaattgtggtgcctttttgtttatgtagacagtttgaaatctgtagaaaattgcaatggattgattctatctttagcctttccttaaaaagaatctatacattataagttttgtatttccttaagtggaagtttgctttgaagggacacaatataaatatttaactaaatggaaaataaaaatattgaaggagttttttctttatgtcagagaaagaaaaaagactatgtgtgcctatatgcaatcccaattaactgcctttggagaactgtttctctaaatatttcaggcaggaacagtctataacagcaggaagaagaaactcaattgaggggttcatggcactatctaaaatgggtgagaaatcattctgtcaaacgagagaggtttgaaattaaacaagtatcaaaattacatactccctgggagagtggtttactctggcaagttgactaccatgcagggtatatgagagtaaactgactataattttatcctgtcaccaggtaactacagttgtagtcaatacgctaatagcaacaaagggctctgtctgctgcataccccgaagcagccagctgccagccagctgccagccagctgggttcttcaagtaaagaatcaagttcccctcccagctctttagaacaccaataaaatctgatggacagcgatttaaaatctgtgaagttcttatatccactagtgccaattaccaaaaaaaaaaaaaaaaaaaaaaaaaaaagtgtgaaacattgtaggatatacaaaaattatatttggtctttgtatctggttcctagcatagagctcccaaaacgcttgggatttccagagtgataggagtgtattttgttattcatagtgaattcctttcaattacacctgagtttgtgctgatgagatgactcttaatgggcctccagataactcaggttgggggctgatgaccagaggggcccaccatgtgattagaggtttggaactttcagtccccctttccttcacctccagagaccctgtaaccacccaacaggatcaccttgcttgctgcctagacagagccaatttatcaagtagagaattccaatagagaaagagtaattcactcagagccagctttgtgggagtctagagttttattattactcaaatcagttttctagagcattcgggaatcagagtttttaaggatgatttggtggatgagggatcagtgagatgggagtgctgattggttggatcagagatgaaatcatagggagccgaagctatcttcttgtgctgagtcagttcctgagtaggggccacaaggtcagatgagctagtttatcgatctaggtggttccagctgattcattaagtgcagggtccgcaaaatatctcaaccactgatcttaggttttactatcctgatgttatccctaggaacaatttggggagggatagaacttatagcctccagctgcatgactcctaaaccgtaatttctaatcttttggctaatttgttagtgaaaggcagtctagtccccaggcaagaagggtatttcttttggaaaagagctgttaccatctttgttttaaactgtaaaggaagttcttccaaaagttaggtggcctaggcccaggagttaacaaagacaggttagaggtgagaagcaagatggagttgattaggtcagatctttttcactgttggttataatttctttctgaagtgagaatggtttctttttattggagttcctaaaaatcgagattggaatgagataatgtaatacatatataaataaggaaaaataattttcttagacttctaatcattagatgatatatacaaagccctttgaacaatacctggcccattagtgctcaataaattagctttcccagaaacatcctccatgtcttaccccactaacactccctgccatcaggttcctttgccaaggtgacgtagccccgccaaggtcagtgacaaggatgtgatattaaggagactattcagtcctgaccctgtaactgcccaacagatttcaagtggtttcagtcccacagaattttttttcccttccacacctcccagttctgtgcttgaatgtatcagagagcattgaatactttctgacaaccaacaagtccatcacttttaatataacagctttttggtctgagcacactatgaccaaagatatttaaaatgatattcctcaggaccattattcatgggccttgcactcatgccttcaagagctgtatcactttgttccagaatccagaacggccaggcctctggctttgtggctcttgtttatggtaaagtagaaaatatcaatatcaatcacacaggaaggatgaattggggtaggcctagaacatattgcatggaggatgttggggaaaccagccccacaccacgtggtgggtaccctgagtccagcggagacaaaggagttagtgtttaaaaggcgggtccaggggacctccgtgtcagaggcttgctcatggcccagagctcttcagctctgcctaatttattggtttacaagctctttgttcttagggcaaatgtaaggcgtaggaagggatgaggaaaatgattaatcagtgaaggagaacttgtgagttattcaataagatgtatagcagtggcaggttttgtgaatttccttgagcagaggtgtgtgtctaaactacttaagatctttaacttatcaggactgaaatggttgggagtgagtttcaggaggagccaagatgtttgattatactccactgcttcaggggagtgttacctccctgagcaacctgtagaatgccactgagtgtttatgctcttggggcataaagacatgaaggcaataaggagacttttctcctcagaggctgcccatggctccccatgggtgtctcacacagggaagaccaacttatctggtgcctttaccttttgattatgttattaaactgaactggggcccactcacctggtgcaacaaagccaaatactgacatcaagattgcagtgaaagtgaaaccacctttgtagaaattataacagtgagagaaatctcacctaactgactccatactgcttctaacctcacaagctaactgcctttgttaattttaaaacaaaggtaataatagtcctttcccacaactaacccctctttgcttgaggactgaaaccacctttgtaagactaacaaaaggccacaagtttgggattatgggaagggcctgaattctgctaagatgtcagcatagttaagcaataaccagccattgttccccagcttgcctttctgtaaacatttactgctcaagagtcatgtagctggaggtcacaagatttgtaacctccccaattgctccttcagataacatcactattgtcaaaacctaagatttatctttgagatatttttcagacttttgcattctgacaacctgctgactcaacccagacccatgactcaattggatctttgacacctatccagaaaccgactcagcgtgcaaagacagtttggatgctcctatgagttcatccccagccaatcagtagaacccattccctatcccccttcccaccaaattattcttaaaaaccctagccttcgagctcttggggaggcagatttgagaattatcttccatctttctgcttggctgaactctctttgccacaaagtcaaactctctttgccacaaaacctgctgttctcagtgcattgacttctctgggcagtggccaagaagaacccattaggctgttacaagagaaagtaagggacttattgtagggtgccaagcaaggagaaatgggcagctcattcttaagactttaattcccccatggctcacggtaaggttttgtataggtggggaggcagcgattacaggcaaagtcataaatcaatacatagaggctatacattggtttgactaaaaaggtgagacattttgaagtagggggcaggcagaggtggattcaaggcttttctaatctgcgaatggttaaggaggcaaagctttgtctaaaactttgaatcagaagaaaataattctgatttgtgggtgtgactcctccaggccccaagcccctcgggaggaaatttagaacaaagagtagaggtcagagtttagtccccatttcccccttatctgaggtttacatgctgtgctggcagatccacttggtgggggtccaggcttctgaaaatcaacttggggatgtacgttaagatgttgtctttagcatccacagggagcaaaacatctgactccaactcccctgtctattgttttaagctactgtgaccttgcttatcaaattgctcatttacttctcagggctagctaggtacctggaattttccttgaaggaactcaaatttttcctttcttttcattcctgggttggggggacagtcccctaagagaaaaataaagaataaggagacacaggaaccacttcccctgcagagcacctgtattagcgttctctaaagggacagaactaataggatagatgagtacatgaaggggagtttattaggataattgattcacacagtcacaaagtgaagtcccacaataggccatctgcgaactgaggagccaggaagccaatctcagtcccaaaacctcaaaagtagggaagctgatagtgcagccttcatctgtggccaaaggcctgagagcccttggcaaaccactgctgtaattccaagaatccaaaagctgaagaacttggagtctgatgttcaagggcagaaagcatccagtgcaggagaaagatggaagcctgaagactcaagtctgctctttccattcctgcttttatgctggcagctgattagatggtgcccacccagaatgagggtgggtctgcctctccaagtccactgactcaaatgttaatcacctttggcaagaccctcacagacacacccagaaacaatactttgcacccttcaatccaatcaagttgacactcaatattaaccatcatagcaccttcacagaaagataaacccacccccaacaggaggtacaggggtggagtgggctgctgccttcaagctggggtgggttgcaggtgtcaagaacagtaaggagtgggggaaccaaattaactctcctcgtctatttctggtgacttcagatacctcactttccattcagagcactagtcttcaaacttaaaaaaaccaggacacatagtttaaaaaataatagccttatgacataaaatttaaaagttaatattaattatcttagtaatatttcaagtgaacatacgggtaaataccaaatttaagcccctcaaacaaaacagaatgccactatgttgactatgacccagtgaattgattgcatgacccacatagtgggtaccaaacccaattgcaaggagactgctgagtgtccaaatatctccaatagcaactcttccttcctcataggcttccatctctgcagcaggcgatttttgtgtgtttgtgtttgttctctcccaggaagagtttaaggtatgtgagctgtgtaaaatgttgcaggaaagtgtctctcaaggtttccctcactttcactccattccttcccaagctggggtgcctagctctttcttcattcactgggggaagaaacaatgactcacctcctcaaagatgaagtacaagcattcctcattttgggagttaagtccaataaaccaattgaagttgaaaataccataattcaaaagtgtgtaaggagtgtactgaatgcagaactttggtactatcgtaaattcgaaaaaacctaaccatcttaagtcagggaccatctgtttaggtatctaaagttttgccagcactctatcatacacttcatcttatttattccttcaggggagggagatggcatctttcagtctcagtagaaggcattaattccttttgtcttttttctggtttttttttttttttttttttttttctgagacggagtcttgcttcatcacccaggctagagtgcagagtggtgcgatcttggctcattgcaacctccgcctcccgggttcaagcagctgtcctgtctcagcctcctgagtagctgggattacaggcgcctgccaccacacccggtgaatttttgcatttttggtagagacagggtttcaccttgttggtcgggctagtcttgaactcttgacctcaggtgatccacctgcctcggcctcccaaagtgctgggattacaggggtgagccactgtgtccagcccattaattccttttttaaaaaatacatttttaggaggatttttgtggtcacctgagttaatgtagaaggtgacaggagaggacctaactccacttaatcatctcctccctgttcctcacctggcttctttgcacagggtggaaatattgttggagaagaaagcaagccagaattgtttcagttcatcttattgcccttctaatcaaaagttgagtgtgtctggaaaccattcaaatgtgaaaaatcttcctaatgaaggcaaactagagaaatggatgagagcaaatcactaggggtgaaaaagcactagaaagttttgaaaaagttacagcctgttatagttccctacccttcactcttgaaagactatgaaaacttcaaatactgccctttgacagcacaatactgtacagctgcagtggcctcgtgttgaaagtataaagcaaatactgtggttaaaaaacatttctcggagttctttacatttccccacttttcatgtaagtttctgtcttatctgtaattcctccatttttatcatgaccttttatcttgttcttgtgttctcccttcgctgtaattgcttcaccatctctgctttctctggttgccttgagatgttcggggctgcttgcttatatagtttattcctttgttttgtctttttgtggcttgtgagcctttctgcctctcaatattcacaccatgcatggtgaataatacaaccagaagtataccatagaccaagcccctccattatgtcttcctcatcccaaaaagtaggtttgtaatcatataacactcatttttatttcttaagatttcattctagcaaattacatgtttttccttatagggctgctttaaaaacttaataggctgtttttttttaatcagttttgatggtttacagaaaagttgagcaaaaagtagagttccaacacattctgtcacagacccctcagcctatcgtctattcccctattattaacaacttgcattagtgtggtacatttgttacaattgatgagtcaatattgataaattgttattaattaaagtctggtttacattagggctcactctttgccttgtaaattctgtgagttttgagtataacaacatgtacccactattagaatatggtacagagtagttttattgctctaaaagtcttgtactccacctattcattcttccctctctccctctcccagaacccttagcaaccactgatcttttcagaatgacatctttcacttagcaatatgtgtttaagcttcctccatgtcttttcatggcttgatagctcatttcttcctattgctgaataatattccattgagtggatgtaccacagtttgtttattcattagggcctcttttctctctctctctctcttttttttttttttttttttttttttgagacattcctgcagccttgacctccctggctcaagccatcttcccaactcagcctccaaagtatctgggactataggcatgcaccaccatccccaactcatttttgtattttttgtagtgatggggtctcactttattgcccaggctggtctcaaactcctgggcttaagtgatccactcactttggcctcccaaaatgctaggcttaacaggtgtgagccaacacacctggcctgttaaaccctctttgtattacaaaatcttagtgatcctggcttttttcagcacaaccaagatatttgatttctgtacgacaactacaacatacatattttgatgcctatggaatagccctgttttctcacaaatcagaatactgcaagaacagataacaaccataaatgtattgctgtatttcatcttcatttgccatctggtctcacttgaggagaatcttatttgaacatcaacaatatcctaggtatcctagaggacaccctgaattaatggctgagatcctcatttggcgagtaccatgcaaggtagggaatattcgtcatcgttttcctctggtaaattatatttctctttaagaaaaaagatcagacacatcatggaacactgctgattttgtgttcatctctggtatatttgtgtgttgtatgcctgctgccattgtccgtttatttggcacatagttttccccatcagcatgtgtctggatggaatccaggtgaaccctgtggacctggctgacccctactcccacttcagtgatgctcactaggtggtgagaagatggaggcagttccgacggctcaatgaccaagttcatccctggttaacccaaacaggactgtttcagttctgaaataaaattgaaaacacaccctggaaagggacatagaatgcaaatccttagaggacacttcctgtgttctccatttcagcctctctccctcagaatctattagagtgccttctcttgatgaaaactcagtgtgcacattcagcttattaaaataggacacgattttttggcatggtagatattttaaaagtcttatttaaatagagggtctgattttttaatccaaggtagtaaattaggaatgggaaacctcaatttaatctcattttagtgaagatttattgagagcctactagatgctggaaactgtggtaggtataatagaagatgccaccaggaatcagaaatggatttcagcttcagaaagtttactgctttaggaggactgatttgctcattaatagtagaaaaaaatacgttatgagaaaagaataattcaagttaaaggagctggtgggagaggttaagatgtccagatgagattgtcctatatggcatgagcaccttgaagatgaaacttagcatgtcaagctatctgaactaggtggtaaaaactatgaaggcaagaaaatgggtgtgttgccctcatctgatgagtatgtctggttgttaaatattgtctctctttgagttctgtttcctactccacgccatctggattttctctcactggctctctccatgtgcctcttacctcctttttcttattccttctgtctctcttctcaaattgtcctcaggactcaagatttagtaagtattacatactttgaatgaatttttatattgtctgtgactactctttaaaggtatgtgaagtagtttgtatatctcacaacactgaattaaatgtgtttaatgtctatggagaggtatcatgctcagcactttgaagcagaaggatgtctatcttattcacctgtctttaatagtgcctgggacacagctggtgactccaagagatttcaagcaagaaaacctggagtttgtatcatttattagttctgtggcaatggaaattttgcccattttttaatgtcttctcatctaagaaaagggggtaataattatatttcaaagttcattttaaatcagaagaaacaaaagataggaaaacacagccatcaagtgtttgaagtattgtgtgttgccatttgtttggatggcaatcaagagctcatgaaagagtaaaattctccaggcacagaagaggcaccattcccccttttcagttaacctggttagtatatttttggggttccttcaaggtctataattccacatttcaggaccatctcatttcaccaagcttaagacatatttcttatacatcttttgtttggacctacatttctaaatctgttccctttctcttgtaccactctccctccccgttacaatgcactgtaatacatcttggaaaaaagtccactctgccttcctaacttgacacagacagcaagatccgacagatttatttgtaaatgggtcttttatgcttcatgtagctcagcgctgcataaataatacctggaaaacttttcaaatttcagcccattggcaggcctgaactccacatacgttattagaaactcctacgaagtgaatctaaatgccacggtccttgtagggggctacgtggctgatgcggcaggtcaggaaaatgcatacctttgcgtgagttcctccaaactcaagactggggggaggtggcctcaggatgtcctcttgaactgagtacatggattacaatcataaatgttttggaatgaaagaagctgagagaaggggaaggaacatttgacatatcatagtatgatttccaggcccttaagggattgtagagaggaggctgggatttttaggacactccctgccccaagaacacatatgcatgggcatgtagtcccatgcaaacttacatactcccaccaaaaccaaagaacacgtgaaatggactggtcacatttgagtaaagtggtcacctaggaacagtgaaggagcaaaggtgaaccctcactgagagtaacctgcctcatttactccatcctgctcagttccactgtctttccttagccattttgtttgtgggaggcaaccctttcttgggatgaaagcactgtccccacagcacagtggaagtatcctagggtaggctgtcttagcctttatctgtcaataacacaacaatatactgcatcttccctaagtcagtagttgtctcttctcttgacgataacaagtctcaatggtggtgctctcacatgggttggggactcctcagctgtagcaaagataaggccaggtaagggctatactactgaaaaaaccagctgggaataacgtagtttatcccaaactcccgcggattgacaggatggtggcacttgataattgctgccttatggaatgagagaccagccacatattttacgggacataaacaagggcattggcaagtgaacaggtgggtgcaacataagattgacagataaaatacaggattcccagttaaatctgaacttcagatgaacaagtaatgttttagtttaagtagatcccagacaacccagttatattggagtttttaaaaaactctctcatatatatgtatacacacacacacacacatatatatatatatatgaaggtcctgaaaagtgtctttctagtgagtatgaaatgataaagtgttgactatccatgtcagtcatgattactaacttttaatttttattttatttcagtagcttttggggaacaggtgttttttttggttacatgaatatgttctttagtggcgatttctgagatttggtgcacccatcaactgagcagcttatactgtatcaatatatagtcttttattcctcacccccctgctaaccttccccccaagtccccaaagtccattgtattattcttatccctttgcatccttatagtttggtttccatttataagtgatagcatacgatgtttggtgttccattcttgagttagttcactttgaataatagccttcaacttcttccacatttctgcaaaggccattatttcattctgtttcatggctgattagtattccatggtttttacataccacgttttctttatctactcaaaacaattttttatttagcataagtaaagtcccatgcagtatttggccaagaggatcaattcggggggtgggagaaagccccatgactgacagtccttttatgttacacggaatctgggaagcacttccaatggaaacagaagaaagggtgaggaaaagtgtgttgacataaagaaacaccttcaccaacaaaaaggaaacacaatgatcatagtccctacagatgaaataattgaaattaggctaaagggaaaagataagtaatcattttgatccctaaatgttttgagttgtgctttaatctctaaattttggaacatttttcttacagttattcaccatgagtagattaacttaagtaaatgtcactatttactctcaaatttattttttggaaaaactagcggtaagaaatgtactctcatccaggttcatttcatttgcactctccacacttcctaatcttttctagctattttcacatgttttaaaaaaaatgctcaccatttccaaccgtaaccggaaccaagcaagtatttaatcatttaatgcagttctctattgacttcccagagggaaatctggggattttgaatggaaattcagagcaatgtctgtgttgcccttgccccactcagattccacttctccctaatttatgcctttcttctcagaaggagttcatcgagttcattgccaacttccactgcttcattaccaaatgtgaacctccccctggcactaggcttactttagcattttttcctcaggtgagagcgtgaaatgtctcagtttaatcacttgtgagcagagagggcaccagatagcaacccgggcgctctcccacctgcagcttcgataggaaagaatcaatctagcatataaaagcaggcacagataaattgctaaacactgtagtacaatgacggcatacatctccggaatgagaatcttcaaaatcaataagaattgaaattgaaaaaggaagaattgtagctgtcaaaatgcaggatgctggcaggttattcacgttgaggtccattttggcttttctagcccaggagaatcatctgttaagaaaagttgtctctagggtgacctttgttatgtctctttgaaaaaacattgtgtctcagcctagggactggattcttcttccaaatcataattgaccttatccttcatgtcatgttaggggacattcccctcagcgagagagggaagcccgaaggagaattagaagccagtgttcagaggctcatgtggggagggggcctgggtatagtgaggccatgtgggctggaaggactttagtttttgaccaagttttacaatctgttctatcattttctgaaatttgaaattctaaaaaaatcaaggaatgtactaccatcacaataataatagcccattatttactaagtaattatatgtgcctgcattgtgcaaagcacttgatatacattcttatatatgacaataatggtgataatactgataatagctaagttttttagtatgtatttgatgggcattgtgtcatgaaagccttatgccacccctccaaactatgtacaattacgatcccattttacagataaacaggcttaagagtggttgagtaccttgcccaatgtcacacagttggtgggggctggggtggacatgaatctcactctgtctcgctccagaattttcctgctttgcttccttcagtcatgttttacatctgtgcatgttagcatttctggcagctgacagttgggctgcctttgatgtttttttgtccatgactcattctactgccctgcaatttcctcaccccaaatggtaggaagtccttcctcatgcccggtctactttcagttataacttcttggacatgtttctttttttcaccaaacttagagcaaaggagatatggaattttccttttggcatttggaaatctgtaagaatcgccatcatgtgatttagcgtgtgtgtgtggttttttaaaactaacatacaaccattcacaaattaaccactgtacgtgtgtcctgaaagcatgttttaaacctcatcttcatgtaatgattaaaaacaaaagtttgttgcctggaagacccactaggagtgcaagtagcagcagggcacagaggagaaagaacttgtcacaaaccgtgggaaccagaaacctgtcctgtctctcagttatgagatgaaattcaaactgtgaggctctactttctgtatatctgcattttaaaatgtatctttatttttccaatcttttttttaaagaaagattgtgttaaagggatatatctgggtgcataggttaccttaagatgtaaccagttagcagatttgttcaaaagaacaattttgcttttgaaagcaaaattgacagattaatatcaattttttttttttagcaaactgtgtttctaaaacgtatacattatcattggcttgaggactgagggactaaagtctatacacatatatttttcatgagcacgatgtttgtctttcaaatagaggtttcatcggtaatggtctctagggcagggtgcttcaaactggaaagtacaggaggcacctggggatccagttaaaataaaggttctcattccagagctccagggtgagacctgagactgcatttctcccaggtgacatcaatgcagctgattagggttcatactttgagaagcagggctctctactaccatacagattttgttaccatgaagaatatataaggaacattatatactaggcgctaattcatatgttgttcaataaattgaactgctctttttgtttgcctttttccctccaagatacagttgaattagttacacagacctatattctcagttcttctgaaaggcaaagtagactttaaattggcaattgctaatttcaatgtaaaatatctaaaaagtttagaagtgggtatcagcttgacttgtttataactaacgaaggggtctcaggctaaattctacaaggctgaaactaaccagttggccaacataaatgagtatcttatttgaaagaatctttttactacagaatttggaaattaaagctaaatttgaaaccaacttatatccttctcctttttcctcatttgtcccccaaatactttctaacttcccactcaacttctctcagcctctatgattaaggagactaacctagtagtggcactttacattttactacttgagcaacataatatttagaaatactgcctaaatatgacagtgcattttgagccttcgctgctttaaaaacaaacaaaggtttacagaggagaaacctcgcaaattctaccttggccaggtgatgaagcttagcattgctggtgagaagttttattgatagcacataccacttagtatgatataacaagaaaggcattcatgtttgtggcattcttggcaaaactcataaccccaagctaatcacaagaaaaccagcagacaaacctgaattgtgggatgatctacaaaatacctaactggtactcctcaaacttgtcaaggtcattccaaacaaaaacagaaattctcacagaccagagaaaaccaaggaaacgtgaggaccaaatgcagtgaagttccctggattgagtcttgggacagaaagaggacatcagtgaaaaaacgagtaaaatccgaatcatgtccagagtttactaaatattgatttcctgcttttgacaaatgtaacagtaatgtggtaacattagaggaaactcaactgggtgagggatatataggaattttatgtaccacctttgcaatgtttctataaatcaaaaatgatactgaaatgaaaaacttatgtaaaatgatgttgacactagggagggagtagaaagtgataagaatgcctcatggacactttttttcccctataaagtgtgtgtgtgtgtgtggtatgcaggagtgtgtattttgctagtcatatactgagaaaaataaagtcatacagaaaatcaaaggctaccactggttcaaaaaggaaggcatgagaacatatcagtaccacatggaaggtgtctttaataaaaaggccttagtcatgaaagttagcccagatgctcagctgacacttaccaaattgctttgaaagaaagcatagtctagaggaactgttgaaaaatctgtcgagtgactaatcccaagttggatcccaatagaggaaattggagagatccattaggcaggcgaggctgttcatttcctcggaattattgaccgtggcaatgcccttgctccctacgcatgtgccaccttagaaactcccctgccggaatcgagttaagtggaaacatcacaatcaataaaagatactctattttccatttgctcattgttttttgagggcttattttggaacagcacgaggaagattcaattcaatatcagttcaccttctgggtggggagaggactccagatattgactttcagggtctgataaagtttgtgacaaggctcagtttgctaacattctgaccaaaatgcaacctcagccacagaggattcagaataagcagatgttcagtgtcacttcatcatcctggaacccttttctaactcagcaaccagtgtcagcagagcatcttcgggctggtgacctggcaatggaggaccctgctcaaaactattgaactgagtcacggaatcatgggaaataataaatgctattctgacactatgttttccagtggttttgttacatagtaaaagcttactcatacagtatatactacttgttagaattgtttactatagaattgttatattttttctctcacccaacttaagccttaagagttcaaatcctaattcatgtagaggccaagatcaaatattttgtcctcagagatctgcctctatctgtaagtcataattaattgttcctctttcagtgattccttgctattgttgtattttacctgagacactgctgccgtacttcattatacctttatcgtctatttctgtgtttctctaaactctacatggtaaggtgtatacatttttggtgactagcacagtttagtaggcactgaaatatttattgaaattaactaagtgtacagaagttctaggaaattttttgttttattaaccaacttctttttttctgtgggggtctttgaatccaacatataagatcttcttgagttttgaccaacctgagaaataagaggttagtcaaaactcaagaggatgctatatgctggactcaaacagaagaaatggcaatgggagtatattatgtctattctattagcaagaaaagtaagattagaggacacagtatacctgtaagccaacatgctttctcattctcacttccagacttaactaacttaccccgttgttagcagcgctacactagactgtgtctgagtgcagtcttgaagatcaccctccctgtccctcccctagtgtagcagtgaccctgctccatgtctccattgtacatatgcgtgtttgggtgcccataactcttcctggcaatattaattataggtgaagacctagcaccctagttttctgtattccttgtgcccaggagaactccagttctggagtcgcaggcacagagttagtacttggcaaatatttgttgaaagatgaagctctgtgattctggagatagattttatcatctttctcacttaattggcattaaaaccatcatacttatcacacagcagcttttctatgacacataacactgcatggacagaagggaaaatcaagctgtatgtgacacatggtgtctggtgcatatgatactcattttaataggcacatcctcacttaaggagaacagttagaactcattgcaataataagggatgattagcataggcatttgccacttgtgcattaacttaacctaatgattacagtagttttttaatgatttaaagataatgtgaacatgacatgttctgaaaactcagtagggatttggttgattttttgtacttcgtattttcagcaactttcgtaggtatgtaatgaaatgccttggaagatgtttctgtaaggaatgtagctctcagattctagtggggcatgtgatgcttcttaaacatagattcctggtctccatccctcccatcttctgattcaggaagtctggcatggaaaccagcattcggtatgtttaaccaccaccaagtggtttggattctagtagtctatctgccaccttacatttaagggctcttttggttgccaggaacagagacctgctcgagtcgctggagtttaaaggccatctttcttttggaaggatagagaaatggcccaggaatacaggaaatattacacaagcagatttgtgcaaggtccaacaccaaagcagctccagggactggcctgaccctcatctattatggactgaatatttgtcaccccaaaatatgtatgttgaaatcctaaccccaaggtattaggaagtggagcctttgggtgataattaagtcatgtgggtggaggcttcatgaatgggattagtgcctttataagagagaccccagagaactctttctgccatatgaagacacaagaagtctgccatctgcaatgcacaacagggccctcactgtgcacagcacaggacccatccatactggcatcctagtctcagacttcacctccagaactgtgagaaataaatatttgttgttaagccagcccgttatggtagtttgttatagccacccaaactaagataccacatctgtctctcttgctttctctgattctttcttcatgtctaatctcttctcgctctgaaccacttctccttaggtctttaggccctcaggacatgggcacaggccacccctctttgtgccccagttcttacctaaagttctcatcattacctaggagcttatgagtgctgctttcctgagagaggatctaattggtgcagtgcatgccctggagccctggcatacaagttgaaggtcaggaacaacctttgtgagaaccattcctggctgggcatccactccttaggcaggccgctgggggtgggaaagaaggttctagaaagcaaggtggctgggaggctgaggggcatgagcgaagtgtctgttactgacacttgttgtaccctctcatcatctcaacctcagaatttctgacagataataagatatggagagaattcatcttaacaaaagacctttaccttaaggagtattcacaactgcagcccaattgtgacactactgtggagtgtgatgtcttaataatacaaagacccaacggggaagttccaagatgtttacggatagagaaactcttaaaattcaagggctggaagatggagaggacctacttaattaggaacatattttgattcagttgagtcaaactttgagtgctcattatgtcttactgctcctgagaattagttgtgttaggtggcatcttagccagccagagttttccatgttgcttttggttgatttggggtttttttaaatcaaaattagttgggagtaggatttacttgatggaaatttacctagatcaactcttttcacacttcagaagttaaaaaaaatccatcatattcagaattgatgtgtttggcaaaataattatttcgagttttctgtgtgtgtgcacacaagtatgtgaatgtgcgataagaagaagtatgcatttggagtcaaaaaccaaatattttcttgaaactcataaactgtccacaggttagaaagatttcattttggacattgcagtgaaacttgagtaattatccatgttgtgtgtctgtaagtttgacagtgatgccttcaaaatattttgatatgcaacctttcttctttccctttgtgttgtcggacaacatgccagctgtcagatggagggaagaatgaaactttggcatcactattcctgccaccttcaccgagaaggccctataaatagcataataggataaaactggccacagagggagagcagcagctggcacacgttgtatccagagctggaggtgtaaatgaatttcaatatcttagtgataccaaacaacagtaagattacagagaatgaagcttttgttatgagagagcccagtatttgaagtaaataataatgataatgcttttcattatcaggcggctttcccctttgaaagtggttgcaaagaagaaagggccctgttttcagaacaaccaatttcctctcttatctctctgaagagtctcccctgatttccctcttttcagaattgggaggtgatactgatctgagccaggtggtaggtggagtgaattaagtcaattgttaacttaaaatgttactatgaaatatattttgctctaattaccagaaaaggaaataatagaggacttcatctggaatgttcttaattgtcaccctatttcttggcttccctgttctctgctcattccttgccatttcaaatttgtcacttgaagtgcccatttgtcaactgaagagcccatattcagttctggttcttttttcctctgccccaaatgcttcatatcaaaggagctcaccctcctttgaggaccgatagcatgtacagaaacacacacgtcacacacagctaagcatttgtatcgtcctttaattgtgtcttatactccatgtttttaaccagattttgaacttcttgagactacagaagacttagtctccaatttgctgtcatggagcccagcatatttctagactcataatgctgccttgtgcccaacctaaccagggtaccttgaaccagcatcaaaagacgcagtcccaagaatctcaggtcagtggcaaaagttttggtcccctgaccttgtgccatctttccttacctcctgcctcctgtgtcttctcagctctcaactccaatctgccactctggtcccacacttccccatcctgcttggatgcagtttcaatgactccagtttgaccagtcctaatctcgccccagcagtaattttgcaggaccctctgactcctggccactctggctcccatttcctcttggtgacttctctgccttaaccagcctctaagatcaggaattggaccacagatgctcaattgtaaaacggcaaccttatctcttgtaatcaatccaaatcaagcccaactttgtgccagggtcacagctccacataatctaacctcctcaatgtctccagccttttttttctgccttctctcccctccccttacctcattctagcatttacatggccattccctctgcctggaatgcttttcctacagcggatcacatgtctgactcctgcccatgttttcagatcattctcaaatatcctgaagttgacctcacccagttactctctcaaccatttttattgctatcaaagcatatatcaccatctataattatcttatttgtcaatttgtttaccctctgtcccctcccatcagcagaatgtaagctccttgaacacaggagccttatgtatcttttcactatcactatcactttcactatcactgagggggcattgaatatagaagatgcttactccatggatggagggttgcatggatgtggaaggagtgagaacacagtaaaatagagttcttaattgatctctgcttgtgtgttctctctctccctctctttctctctctccattcacctcagggtccatgacttccctactgctatatggtccagtaccaaattgaccctgaaattgtgaacatcacagatgccaaactattttggtaaacggtggttggagatccatgccgagccttgcttaattacctgtatttcctcacatttaaatagagtggataaatttctagttgaatatttgctgaatataccatgtagatcagacaatggtgctgtgtctactaactgtggagatgatacgccaccaccaactggagtaagctccatttgcccagccctattcagtgttcaaaggggttctgctatatgtttctggttgatgtaaacaaaaacacaggcaactgtgatgatcaagtaatattaccccatttcacagacaagcaaaccaaggctcagaggctttgttacaaggctgttaaaaacaagaactgaatgtatactgtggttgtgaattctaatctgggctttcctaccgtaccctgtctttctcctggtcctctgtcactttgttctggtttcttctttactgacagtcatagtcaacctcaatgaaatttccatgaccaacagaggaaggcctcctgtaacagcatatccatggggtctttagtaaatctccttaataaatgtgtccctaggagggaacctggaggcagtctcctttcccaatactcgaagacaggggtcagcaattttttctggttaagagccagatagaaattttaggctttgtaggctaagaaacaaaatggatgatattttgtagattcttgtatgacaagagatagaactaacttccacaaattttttctagaatttaaaaaagtaaaatctactcttagctcatgggccatatgaaaacagccagatttggcctgtggattgtagttggacaatctctgcttaaggagaaaagcagacatactgtcccagggctgcattatgttgagtttcactgtgaatatatgtatatgtatattaatatatgattatatgtgtgtttatgtgtgtatatatccttagagggcatacccccaatacataccctgaggttccctggacaacgtcaaatctcattgaccttgccttcaaccaaggacgtgtggctccttttccctggagatgtagggacagtacggggtgcgctggcttctatgcttgtgtcttggcagcccttctgtagaaagttggaaagggctatacctttcaccttggccacaggagacgtattctctcacctgaccttggtcaggtgtagcttgttaggtgggcagtcttgctgggtatttgccatctgtcattgagtctctctcaccttctctacttagaggtccctgaaggaggcctttatgcccatccagtctttcaactctcctcagagacacatcacttatccaaaaccccactagatttgactgtcagattttcaggtatcaataaaactttgtgttgggaatattattgtatgggtgagaccatgaaggcagttagggttaggccgactgagagtgctgtttttctatatgtatgggcatgaggccttgtttttcactgaagggggtggtaattataatagaggtttaagaactgcctgaccatttaacactgagttgttgggttataccttaaactgtattttgactgtaacatgtgggctttcttctatggaaagttcttcccatttttttaacttttaagttcaggggtacaagtacaggtttgttacataggtaaacgtgtgtcatggaggttttttgtacagattatttcaacatgcaggtgttaagctgagtacccattagttatttttcctaatcctctccctcctccaaccctccaccctccaaaagaccccagcatgtgttgttcctctctatgtgtctatgtgttctcatcagttagctcccacctgtaagtgagaacatgcagtatttggttttctgttcctgtggtagtttcctaaggataatggcctccagttccatctatgtccctgcaaatgatacaatctcattttttatggctgcatagtgttccatggtgtgtatgtacaatactttttaaatcctgtgtatcaatgatgggcatctaggttgagtccatgctttactattgtgaatagcgctgcaatgaacatacacatgcgtgtgtctttataatagaatgatctatattcctttgggtttgtacccagtaatgggattgctgggtcaaatgataattctatctttagatctttgaggagttgccactttctttctttcttttttttttttttgagacggagtcttgctctgtcgccgaggctggagtgcagtggcacaatctcagctcactgcaacctccgcctcccaggttcacgccattcttctgcctcagcctcccgagcaggtgggactacaggtgcccaccactacgcccagctaattatttgtgttttttaatagagacggggtttcatcatgttagccaggatggtctcgatctcctgacctcataatccacccgcctcggcctcccaaagtgctgggattacaggcgtgagccacggcgcctggcccacactttcttccataatggctgaactaatgtgcacttccaccaacagtgtataagcattcctttttctccacagtcttgccagcatctgttattttttgactttttaatagtagccattctgactggtgttagatggtatttcattgtggttttgatttgtatttctctaatgatcagttatgttaagatttttttccatataattgttggccatttgtatgttttcttttgaaaagcatctgtttgtgtcctttgcctacatttttatggggttgtttttctcttgtaaatataagtttcttttagacactggatattagatgtttgtcagatgcatagtttgaaaaaattttctcccattctgtaggttgtctgtttactctgttgatggtttcttttttttttttaattatactttaagttttagggtacatgtgcacaacgtgcaggttagttacatatgtagacatgtgccatgttggtgtgctgcacccattaactcgtcatttagcattaggtatatctcctaatgctatccctccccactccccgcaccccacaacaggcccctgtgggtgatgttccccttcctgtgtccatgtgttctcactgttcaattcccacctatgagtgagaacatgcggtgtttggttttttgtccttgtgatagtttgctaagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaagtagtttacagtcccaccaacagtgtaaaagtgttcctatttctccacatcctctccaggacctgttgtttcctgactttttaatgattgccattctaactggtgtgagatggtatctcattgcggttttgatttgcatttctctggtggccagtgatgatgagcatttcttcatgtgtcttttggctgcataaatgtcttcttttgagaagtgtctgttcatatcctttgcccactttttgatgggattgtttgtttttttcttgtaaatttgtttgagttcattgtagattctagatattagccctttgtcagatgagtagattgcaaaaattttctgccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaaaggatccagtttcagctttctacatatggctagccagttttcccagcaccatttatcaaatagggaatcctttccccatttcttgtttttgtcaggtttgtcaaagatcagatggttgtagatatgcggcattatttctgagggctctgttctgttccattggtcaatatctctgttttggtaccagtaccatgctgttttggttactgtagccttgtagtataatttgaagtcaggtagcatgatgcctccagctttgttcttttggcttaggattgtcttggcaatgcgggctcttttttggttccatgtgaactttaaagtagttttttccaattctgtgaagaaagtcattggtagcttgatggggatggcactgaatctataaattaccttgggcagtatggccattttcatgatattgacacatacactctcccaagactaaaccaggaagaagttgaatctgaatagaccaataacaggctctgaaattgaggcaagaattaatagcttaccaaccaaaaaaagtccaggaccagatggattcacagctgaattctaccaaaggtataaggaggagctggtaccattccttccgaaactattctaatcaatagaaaaagaggaaatcctccctaactcattttatgaggccagcaccatcctgataccaaagcctggcagagacacaacaaaaaaggagaattttagaccagtatccctgatgaacatcgatgcaaaaatcctcaataaaatactggcaaagtgaatccagcagcacatcaaaaagcttatccaccatgatcaagtgggcttcatccctgggatgcaaggctggttcaacatatgcaaatcaataaatgtaatccagcatataaacagaaccaaagacaaaaaccacatgattatctcaatagatgcagaaaaggcctttgacaaaattcagcaacccttcatgctaaaaactctcaataaattaggtattgatgggacgtatctcaaaataataagagctgtctatgaccaacccacagccaatatcatactgaatgggcaaaaactggaagcattccctttgaaaactggcccaaggcagggatgccctctctcaccactcctattcaacatagtgttggaagttctgtccagggcaatcaggcaggagaaggaaataaagggtattcaattaggaaaagaggaagtcaaattgtccctgtttgcagatgacatgattgtatatctagaaaaccccattgtctcagcccaaaatctccttaagctgataggcaacttcagcaaagtctcaggttacaaaatcaatgtgcaaaaatcacaagcattcttatataccaataacagacagagtgccaaatcatgagtgaactcccattcacaattgcttcaaagagaataaaatacctaggaatccaacttacaagggacataaaggacctcttcaaggagaagtacaaaccactgctcaatgaaataaaagaggatacaaacaaatggaagaacattccattctcatggataggaagaatcaatattgtgttgatggtttcttttgctgtgcagaagttttttagtttaattagatcccatttgtcaagttttgcttctgttgcaattgcttttgatatcttcatcatgaaatcttttcctgtgcctgtgtcctcaatggtattgcctaggttgtcttccagggtctttatagttttgggttttatatttaagtctttaatccatcttgagttaatttttgtatatggtataaagaaggcatccagtttcagtcttctgtatatggctagccagttacctcagcaccatttattgagtaggctatcctttccccattgattgtttttctcaagtttgttgaagatcagatagttgtaggttggcagtcttgtttttggattctctgttccattggtctatgtgctgtttttgtaccagtaccatactgtttggctactataaccctgtagtatagcttgaagtcaggtagcatgatgcctccagttttgtgctttttgcttaggattgccttggctattcaggctcttttttggttccatatgaatttttaaatagttttgtctaattctgtgaagaaagtcaatggtagtttaatgggaatagcactgaatctataaattgttttgggcagtatggccattttaataatactgattcctcctgttcatgagcatggaatgtttttccatttgtttgtgccatctctgatttctttgagcagtggtttgtagttctgtttgtagagatctttcacttccctagttagctatattcctaggcattttattctttttgtaacatctgtgaatgggagctcattcatgatttggctcttgactttactgttgttgatgtttaagaatgctagtgatttttgaacattgattttgtatcctgagatttttctaaagttgttttataaacttaagaaccttttgggctgagatgatggggttttctagatacaggatgatgtcatctgcaaacagggataatttgacttcctctcttcctatttgaatgccctttatttctttctcttgcctgattgtcctgcccagaacttccaatactatgttgaataggagtgctgagagaggacatccttgtcttttgccgattttcaaggggaatgctttcagcttttgcccattcagtatgatgttggctgtgggtttgtcataaatggctcttattttgaggtatattccttcaatacctagtttattgggagttttaaatgtgaagcagcattgaattttaatgaaagccttttcggcatgtattgagataatgtggtttttgtctttagttctgttgatgtgatgaatcacatttattgatttctgtatgtcgtaccaaccttgtcctggggatgaagcctacttgatggtggtgaataagctttttgatgtgctgctggattcattttgccagtattttgttgaggatttttgtatcgatgttcattgaggatattggcctgaaattttcttttttgttgttgtatctctgccatattttggtattgggatgatgctggcctcatagaatgagttagggaggaatccctgctcctcagtgttttggaatagtttcagtaggaatggtactagctcttctttgtacatttgtagaattcagctgtgaatctgcctggttttgaacaccatgcagagttagagacaaagtcacaagtcagtctcctttgctgaagccagaacagggctgtgtgctagtcactggggttgcgcccaagtattccatttcaccacccccttcccggtatgtggaaggttaaaattctctgctaccttgcagttgggtggtcagtgactggctttggatgataaaatgtgagaggaagtggtgtgcgtcttttctagacaaaagcacttagtagccagagcaacactgaagtgctactttttacccagctgtggggaacacagaggcacaggggagatgggcccataatcagccttggtccctgagtcactaaggtaagcagagccctcaacacagggcatgtagtgtgagtgagaaataaacctgtgtggttataagtcactgcaacgtggagttttattgtcactgcatcgtaacccagcccatcctgactgctatcatttggctagcccaaatataggagagttgaaagaaaatctgtcaagctgcttgtttgacactgttaaaaatggtttccagtgaggctatttctggataccgttgttttgttcaccacacttgagctggagcagtgggcagttttgtgtctttgagtaggaaaccaaaaaccaaacctctgtcacagaaagggaaagccacgcactggctgaagaactccggacacttgggtgaatgtcattgctttttactctgcacatattgagtgcctcttgtatacaaggctctgttagaacctcagactgctttgtcagacattttctgaaaggagagctgcaaggattctctttgaattcttacttgttctctttgcagtcaggcaatcagtaaggaggacatctaattagcagctgttgcatctttgtgcagacaatttacaaatctgttctctaaaaggtgagaagttaatgaaagtagaaacatgtggctaaactctggagaggaaacccacccccatccccgccaccacacacccacccacttcatcatgtttgctgggcagctccattccttcagtttgctgaacttggtcagaagaagccccttgctgctcacatgaccccgagtttattttgatctctttggattgaaaacttattactagtttagtgagccctctcttctagcatgagcaggtaatgtgaaaaatcaaaactgacagcacatttaaatcgaacccctaacccaaattgggtgtctgtacatctcatggaacaatttaaatccccagatgaaaaagcaaggagaattattgcaattgctgcagcatgtgtattgaaggtggaaccttccaactgctgacaaccaaatgccaggcaaaccaggtttagattgcagggaggaaataaagtcaccatccattcaagaaacctagagaagccacaaaatagaaagggagaccttcttagtttagtccatcacacacctgtagccactatagaatttactattctgagcaacatcactagagaattacctttttctcctcttactgaaaaatacacagatttattcaatgagtacttttcataagtctccatgagactcttttttagtggaataagaatgaaaaactcataaacaagtggcctctgctgcccaggtgtttatagtataccctgagaaagggcacctttggcttgtaggttcttctctagttgtgttctgccaatgaacaagaagtgaaaggaacttctgatttttgaatcataaatatttctttgtgtggtgggggagtaaaaatgtggtaaacaagggtttgtcagaggctactctgagaaagaggaaagaataaaaatgtccacgttggcagaactataaatatttgctgtttctattcaaaatcactctctgaaccatgatatcaacatgtttgggacaggagccagtctgggtattagaaatgagaatcttctttttgttcacgtaaagaggtaagggagtacctgttaatttatcagaatgaagtatgtggttaaggcactcagagaattgagtacactcaattttgagcaatctggtttcagaaggtcggattaggggagtctcgcttcatgtgcagaactttgggtatcttttaacaagtgtacctgagttcctccagtgctgataaacaaggctttgggcctcagaggtctgcagtggacgtggctttgcgttctcttgacttattatactacgatggcaacaaccagttcacagaggccttggagcagcttagcaaaggtgcaacaagacagcgtcttactcagctgtgcattacacacctgctgcctttgttctgtgcttttccagtgctatggcgcagggtgactgtcagagctgcttggcaaattttcaggtgcaacccagaggctcaagaattagtgctttttagggaaacttttggcaggggcagtgggcagccaggaaataaaagctttctcttctaacctcctaggtggacatttccaagtcatgtttcataaggcccctcagaaggccctaggggattgagcagctcagttcacagtgcccaaggagggccaacctgatggcatggctttgtgttgcattcccccttccctgtctcatgaccccagtccctcactcctgctctgggagtccttttaccaaataaaccacttgcacacaaaatttgtctcaagctctctttggagataacccttcctaagacacattccactcacaggcctctccctccttctgtagaagtgtgtcattttagactaaattcagcctcactgctgttgggacattattagtgaatataaaagatcccagtcacttttctatttccaaaatggttttagaaccaggggcaggtggactgaaatgatcccattaaaatggtctatgacctatttttttccttttgatataggagaggttcttttaatgtgtgtttctagcctgctgtatttctcctttgtgagcctcattataaagccttgacctttaggaaagaaattaaagtatacggccatttcatggtattcgcctatttcatggtattcgccttcattctctatatgctttttgatctttgtggagtataaacaagtctggagagagtgctgacgaggccagcattgtggcctggatcccgcatggctgattagccttgcatggcacaaaaccatcacatagcctgaaattgcattttgaattctgatggaacgtggtgtaaatgtgtgctcttggtcacccgcggtagcagatgacaatgcacatttcacccacgttcctgaacaccaaacgaaagtgcctgtgacagtgactcggaagtgcggtgttgcgtgtgatgagaagaacacgtttatgtaacaaacgtttttagctggctgagcagggctcagatgagactcacggaagcaatgccctggggtgaggagcgcaagggcaggaaaccattggaattgtttatcacttgagacagaggactttgtgagatgctgggcagaagcagaggaccttcaaggctcaggtgaccgtgcacggcactgggctgaggcggggccaggctctccactctgcaagacccaggattagaggtgttgcttccatgcgaggggatggcatgcttgcctcgacacaagtgttaataataagtgtggaggagggcaggcagggagagggataggagtattggactactgagcagcacttggtaaactgaggtaggtaaggggaggaggaaaagaacaaagatgtggtgactcaagagggtgaccatagtcaaaataattgtacatttttaaataactaaaatgatataattggatgtctgtaacataaaggataaatgcttgaagggataaatacctcattttccaggatgtggttattatgcattgcatgcctgtattaaaacatctcatgtaccccaaaaatatagacaccttttacccacaaaactaaaattaaatttttttttaaaaagatatggtgacaacagcacccactgggtagtcctcaacaccaatgagactcagctttgtcagcagatgggcacacctttgatcaccctggctcaggtggaggctgttgagccagcagacatttgggccaactttttctatttcaccataagggactaggctgtggaggactccctttcagatgtttgtaaggctgttgagtggtttaaaaacttggtaattatggtgcatttactttgtcactttctcccttgccccaaatgagctgactctgcagccctatttccaatgataatgggtcatcttggcggctctgcgagttgctgttgtccctgagtttcaggtaatgcctggtggcgccccacgagggctgcagcttgcagaggcttcactaagagtagaattgggtcttcaggataaagtgtgtttgaactaaattttgtggtccaggaatatggggtagtttgtttttgttttttaggtgaaagtcacataacataaaattaaccattttaaagtatacaagcagtggcatttaatatattcacaatattatatgactctaatctctgtacatttctaaaacgttttcatcatccccaaatgagaccccacaggcccacaggaatggggttgtaatgcctgcctacattgataatgacatttttatgagggacaaattttataaagagcaagctgtgtaccacctttaagtttaatttttaaatgatatcgtgttttaattatttagaactgatagacacaatttattttcaatgcaaagaactcgaaaattttgaaaatcacatgggaaaaaacccaaatacaatgcaaagaagacacaggccacagtttggacacaatcacttgaaaatcttttgctaaatgtacatgctcgtctctttccaccatgtcaaggtggaaaatgtgtctgagaatcccctgaaagaatatggacaagtgtgagttcatcagtctcctacgggattgtgctaagcctcttccagcatgtttgaggattactggttaagcagcaagggtggtttagaatcagatcagacctgagttaaaaatctgagccctgccactcactactagaaaaaaagcactgcagtcttctccctcaatggaatggctcatttcccagcgtgttgctaatttccagttttgccccaaagatagtattttaaaaactttcacactgagttcctttctgtatcagatgagtaaatttttctgagccttggttttctcatctgtaaatctgtaatatctgcttcatgaagttattatgaaaattaaatatgagtaaataataactttttaaaaaagaggcaagaacaacaaaggcagagatatagatgtttgggggccagcttggtacagctgccaggccagggcctttctctggcatttcatcctcagagtgagtttgatttaaactcatgcttctacaaatgtagcaaaactgccacatactaaagccagaatgccagacacatactgctaggcactgccttctcctgccagggacagtcttccaattcaatgtgagatgagttttggtaccaagtgatgatgcaccggcaaaggtggagaagtcagggagcagactgatggaggcagtggaaggccatgtgctctgcacgtgactagctcagtaaacccagagctttggaagcaggccctttccaaggctgttgagaatatcagttcgacaggctgctggaggtagacttgctgctggagggaggacatcaacgctcatgcagctgagaggtgctcacacgacatgccccctgatactggttttgtgcaggaattgaggactcattgcatcagctgtcatctagggatggagtgaagtctggaatcctgttagctttgccgggtgacatgtccagcctctccagtttgtaatttgttctgcaacttgttgaacatctgtgcattaaatgctattgaaggtgttgacatctggcaataagccattccccgggggcgtcctgtgcatctctcatgtctctggagacttcatccatccaaaaaagtattccatggccaggtaggtttgggaaacactgtgtacgacatgactctttttcttttctttctttcttttttctttttattttttgagacggagtcttgctctgttgccaggctggagtgcagtggcacgatcgcagctcactgtgatctccacctcccggattcaagcgattcgcttcctcaacctcccaagtagctgggaatacaggcacctgccaccatgcccagctaaatttttttctgtattttagtagagatggggttttaccatgttggccagcatggtctccaactcctgacctcattatctgcctgcctcagcctcccaaagtgctgggattacaggcatgagccactgcgcccggccagggcatgagtctttaagagtcctaggacaaattagcatttacaacctctgagatgttccatagcaaaggaaaaagaaagaaatagtgaaaactgaacttgctatttctcatgctcatttaaacacgaaacctttttgccatttaatacttttaaacagctcctaaaatcggtgtttcctgctggtccacaggaaatctgtcacaataagatataaggttttcagactgagattcgtaaacaaaactcctcaaaaattgtactttgatccaaatgcagattcatatagtgccttcagaacctttgagatctgattctatttttaaagcttcttagaagagagattgcaaagtgggttgtttctctagccagacagggcaggtaaataggggtggctggtgggatgggagttcatttgcacccatgtacaaattgctgggggtcatggtgagctggaaacctacagccctcagctgcagccagtggctgctgtgcagtgggaatatgggtcagatcagtgagagctttaagtttcttagaggacatggaaacctgtaatttttaagcagggaatttcacaactttaatgtgttacttcacatttttaaaatactgtgatgacccagcaaaaacaacaacaacaacaaacagatgttgagaccagccccatctcgtgagctaccaggttgtgaccttgcctgggatggggctgtggactattttcagattagtaagacataataaaatgaaaggatgtgtgagtctctgaggcaaatgctgtgcctggataaagatgttggtgactcatgccctccatagattcgtgatgctttgccttcatctttcttgactgcgagtcagcagcattgactcagctgatgacgtcttcctccccaatacatatttttcaattagtttccaagcctgttcttttgcttttcttcctaccttctccatctcctttgctgttcttcctcttttccccagtatgggaagggttagaaagctctagggcacagcccttgatcctggttttctttctttcttttttttttttaatttaacttttattttaagttcagggatacatgtgtaggttcgttatacaggtaaacttgtgtcatggaagtttgttgtacagattattttttttaccaatgtattaagcctagtgccattagtacccattatttttcctgatcctctccctcctcccaccctccaccctccaaaaggccacagtatgtgttattcccctctgtgtattcatgtgttgtcattactttgttcccacttacaaatgagaacacgcagtatttggttttctgttcccacattagtttgctaaggataatggtctccagctccatccatgttcctgcaaaggacatgatcccattctttttgatggctgcatagtactccatgacatatatgtaccatatttttctttatttagtctatcattgatgggcatttaggttgattccatgtctttactactgagaatagtgctgcaatgaacatacgcagatttactcatttcctcggcaatctcacatggcttcacagtggtagatgctatctatatggcaagagtatacagatttatattccagcccaaatctccttcctgagctccagactagtatatccaagtcacttgtcatctctcgtctgagatcttgagcccaaaagatccaaagtaaaactcctaatctcccgaccctgctaaatctccatacacaactttgcctatcttgattagggtcttggcactggtgatgatggacagtgtggtgagttttgtcacttccttcatatcttgaatgaagtgttccctttctaaggaggtctaccctgacaaccctgttttaaattatacactctagtctgatatacctcttcctgtggcacttatcttctaacatacaacatattcttctttatgtttattttttcagcatcttcctccccacactggaatgtaaatacaccagggtgggaatctccatctgttttattcactgtacccttagattcaatatcaggtgcatagtagatactcaataaatatgtattgaatgaatgaatgaatgtcagttgtcacttggttaaaaaaatttcaagagaaggtatgcttaaagctggtcataaaagtttaatgttcattgtccactaattgcattgaaccacaaaccactgctgtgtaaacaaagaatgtcttcatgatgtttttggtagatagaaaacctactacagtaggggcaggtttgaagaaatgatacgtaaatatatatatacatacacactctttttctgatcagcagttccacatgttgttgcagagaccaaatattctaatggacatgactgtttaagcattctagcagctttctgctgggtttccaattttaaaatttaaaagaagaaaaaaagcactgcagtcttctccttcaatggaatagctcatttcccagcatgttgctaatctccagttttgccccaaagatagtattttaaaaactttcacaccgagttcctttgtgtatcaaagacaaagttattatcaaaattattactcatgttctttgtcatgcaaaaggcataagtaatgtttttaataatgcaagccattaaaaagtagatgggctgaattcattgtgcctgtttctaacccgctttgggaaaggatttttctacgcagaaaggtgtaaccccttgatgcctgcatgagtctttccccccagttttcaatatagagttgaacatgttcttcatttagagactcagagacaaagctgcagcccttcaagttatttccatcaagaagaaaagggttttgaaggagataggctcactgaaaggaacaactttctttggtaacaatggatttggaggaaaataaagcttgtgggatttctttaaaggataattccctcattcaaaatggtttagggttagggccattggacaagagatatcttaggagttaagattcccttcatgactgaaaccttactatcactggctagctaagaaataattgtggtgtgtggggagcggatacttcatatatgtgcccctgttttcctaggcacttaaggtcatgaagttcctgcttgggtatcactaagattaaagaatctatttccactgagttccacaatcttttttaaacatggtgctccgggtagccaccaacaatcagtttgagttggtatgtgaaattatggtgcaggataaaataagacattttgtaagaaagtatttgtaaaggataaatgacaacgtcaggcagagtggcgctcatgaagtctagactcaaggccagatttcatgtccctctggttgctgctactaccttggcagcctttctaaattctacaattcaggtgcctgccctggcttttgaccaatgcctgatggccctctctgaggtgtcttaaaccttcatgcaggtttttagaacaagagatacggtcataagatcctcatctcagctcatcaccctggtatgttttgagcaccctggctacatacaacaaacatctttgtttcgactgccttaaattatttgacatacaaatgtgacattttctgagtttcgtttagaagaaccaggtagcctgtagctttaattccttttacaaataagagtctttgttctagtccaaaagagtcccaacctataaggtcgtataatgggagacaggagagaaggcctgggattagaataggtccccagagaggagaacatgtcgtaactttctcaaaccccaaacttgtggtgcttctctgctactggaagaaagtcgtgtttctttttcccttctcattttcagaaaagaagtgtgaaaggatcaaaagaaaggatttgcttagatgttagtgtggcctgattaggtcggaattagcctttttctcttttcactgagagaagcagagaccatctgcggaaattatttaaattcatgcgccttccagggaagctgttttatttgccactgcgtttattgtagcaccggggagcttgacagtcattccaaacttttgctgcaatagtactagtattgcctgtggccattagattaacaaaaggaaaaattaactttcctcctgctgaaaattaacactttagattaattaaaaagcaaatgcaatcaaagcctctggattttttctccgaaggtgcattctgcagggcctcaggactgcggtgagtctccttagcttatggggagggaagactggaatgttttatcaggattaatttataatgtaatttgctcaatgtgattagaatggaaaccagtgggagtccaaagtctctattgctccatggagaatggattgcactgccggttgtcttggagaaggagaaggagggaaataaggaagtacacatgggctacttgagagttctggagctcagtcacatcccaggtgccccacttcctgtgtgaccttgggcaagtaatgtaacatctcaagaactctgtttcctcatcagcaaaatgggtatacataatagaactcacgcatcacaaagcccttagcacataaggagcattcactcaatggatggtggtcatcattgtgcccaggcacttagtgagatcatcactgatcattacaaacatagatgatgttgacagaattatccattactacttggtctttgggtccaatacacatattccaacccacttgtttcaattatttgggaaatgtagttttgttcgaaggaagctgatttgacaaatggcatatcaaaatctacatattatgtgatagtacattttcttctataccttttgcttattctttcctttgaagatgcttcaaaaatcttcaatgtttcctttttaaaaaaatattctcccagctacaagtttgactcctcaggacccccttgcctggtgtttaaacttctcactgtctcatcccaaacagcctttgctgccttgtcccatggactgtgaaataccctagccacacagaaattgttgccatttttcaaaccggctgtggattttcatactctctgctttggctcataagatttcctccatccgtgaaaacttttccgtgttctaaatctggaaaactctcctatatagacctatctcaaatatctgtttctttataaagttttcccctgatgttaatccgcattttggttccatccttctttgcagaaacaactcatctgtccttatactcttcattttaattttgtgtatgataataacaatttaaagtatagtcatgcacagtgtaatgacattttggtatataatggactgcatatataatggtggtcctataagattataatgcgatatttttactgtaccttttttatgtttagatacacagacacttaccattgtgttgcaatcacctacagtatttaaattaacatactctacagatttgtgacctagaagcagtgggctatactccatagcctaggtgtgtagtaggctatatcgtctagttttgtttatgtaaatctatgatatttgcataacaaagtgacctaatgatgcacttctcaatgtattcctgtcattaagcaatacatcactgtagttattcatttatgggacaaaattatttcctacaatttctagagcattaccatgtgcctggcattgtgtgaagaacagactcatcttatctcatttaagctttccagtaacttacctatgacttgccccatttggcgaatgaggaatccaagactcagacacttaccatggttccataaccagtatgtagtagagcagatgctagaacatgggccagtttgtctttaaagtccatgttctcaaacatagactattgttcccacccattgccaggacagattccattgtgttatgatttatgctcctgccggtccctcttttttaaattgtaagtcctctgaggtctaggaccatggcttatttgccattctattccccaggcccagaagagtgcttggtacccactgaggacccagtacctgccagaaggactggattcatgcctgcatgggcaggtagagacaaacgctgaggacaacggctcccaactttcagaactatgacagtcccataaacgacatcagtttgtgtgcctcctctgacaatgactaatgattctcagtctccttgagcacattaagacacgattacattctgttagctcagctctcctgccttctaaattagagtggtgagcacagtttctctgctccagtcacgttttgctgcagcagattccattcaacctcctgacaccaatttgtgtgctatttcagcatttagtacgaagacaggaaaatggtattcccgcctgtgtcctccaggcagacggcctgctttaaggtttagccatgtgatttgcactttccgcaagtctagtctactcgattgaaattctcctcccgaaattcactcattaaactctcccatgatccatcactatgaaactgattatcacaatgttgtcttttaccattattaatctttggagattgatgctctctggtgcttctgactgacttgcatgattttggctattaatctttatctcaatcaaataatttactgttttaacttggaaggtattgctgctcctgagattgaatcgtatcagcttttatggcttcacagtaaaagctatttttaaaaatctcacaaacgtttgggtttgcaaacaaagtctacttccaaaaatttctgaacactgttatttccctgagcccattccaaacactatagtctctccccgtttttgtcctttctccaccttcatggggacaattaaatgtggtacctgaaaagtgaccttcagatgtcaaattcctggaatatgacagtggcagccattggagtgctctttgcagacctcctactgtaagtgtcataactgactgaaggtcccagccactgcaacttggaatccatcatgggtttgcaacaggaccacaccttctaccaactactccttgcaaataactgagagtgtcacagttatcctgagtctaaaagttattttaagtctaaggcagacccattcctggaagataagagacatatttgtccatgaattttggttctctcccatgcctggtgacaaaggtacacaccctaccttctctcctctctggctcacttggggtcagatttcagcatgaactgattgctctccctagtctaccccagcttcctcccaatgatccagactaacacgactcctttcccatctttgaccagatcaagacctgactgcacatggagaatttaactttaaagggaaatggtattggggaggtgggagaaataggcaaatcaaaaatcagtattctctgaagaagaaaatggaaccagtgaaattactaatggaatgaaatggaaataatttctaagagcatgtggcgtttgttattttattaagcccacttagtttaaggtttaatatgttcattagaatgtattcatatacttctcaaatagttgggaatcaaggcagggaaaagacatgacaaatacactaaaacagggagggtgtgaagatgtactctgcattattctgcagataatcatgtgttttggattctgtatctcaaaagtaggtttttaaaagttaagatatataaactatttacaggcttgtgtgataataatagagatataacgagaaggagatgatgttcattaagaagactgagtttcaagagacagaactaactccaattcatgataattttagacaatgaattgcaaggagagctgatatttactttttctcccccaactttcttttgggggtttaggggctgggcaataacaatttcagtaaattgactgcactgtaataggtacatacaaatgcgtgttgtcaaaacttgtctagttttcaaactaaaacaattattactgaaaatgtgagtgtttgaaaacaaagtactaacagactaatattattcacagtgatgacttagatatataaatcttcaaatttacacacaatgctttcacacagttgtcacatttacccttctctgtgtgatctatctctctaaagaatgcctcaaagtagaaaaagtgaaatcagctccccattttatggatgaaaaaattgagactcagagtagtaactcacccaagagcaaatggctgacaggtggtgctaaaaccatctggaactccatggctgtggctgttacttctcttgctgttcttgctatgaccttcttaggaccaagtgtggcaggcacacatcatagattcagacagaccttgaatgtgtgatctggggaaactgaggacttgctgagctttcgtctccttgcctttcctatcttttcctgaggtacagtgtgtgggagcacagatgacaggatcccaggagacccaaatgagagaaggagacgattttgttttggtggtaaagcagtaacacattgatttcaaatatttatcccaaattccttcccaatgagtagactgtctttgtggtttattaagggggaacaaacatccctagtaaacatgaattcagcaaatatttatgaagcaacttctccatgataagcatggggctaaatgttgtggataaatacataagaggctgccagtatctttggagctcatagtgagataagacatttctcaagccgtcttcctcaatcacctggggagcaagtgaaaagcacagattcatggaacgcatcccggtctgactgaatcagaatcactgagggtgttggtgggagtgggagggggcagaaatgtatatattgaaaacacagaccagctgatttgctccaatcacatccacacagatcaaaactaccatactgttctatttcccctatttagatgacttgcattaattacataaactgattatttggggatgcatggctgtgacctgacagtagggaagaaactcaacatggaaagaagtcacaatgtatagttccttacatgcaagtgtgagttttatcttcttcctcctgcagtgcctgtcagaagactggctgagtgaaaggttgctctgacagaggctagcctgggaggaggaaaacttgaaaccttatctcaaatcagctaataattcaccctgctctctggttcatcttgttgagaggtgaagccagctggacttcctatgttgagtggggacctggagaacttttctatctagctagaggattgtaaatgcaccaacgagcactctgtgtctagctaaagatttgtaaacacaccagtcagcactctgtaaaaacgcaccaatcagtgctgtctgtctagctaaaggtttgcaaacgcaccaatcagcactctgtgtctagctaaaggtttgtaaatgcaccaatcagcactctgtaaaaacgcaccaatcagcactctgtaaaatggacagatcagcattctgtaagatggaccaatcagcaggatctgggcggggccaaataagggaataaaatctggccacctgagccagcagtggcaaccttctgaggtccccttccacgctgtggaagctttgttcttttgctcttcacaataaatcttactgctgctcactctatgggtccgcactacctttatgagctataacactcgctgtggaggtctgtggcttcactcctgaagtcagtgagaccacgaacccacggggaggaacaaacaactccagacgcgccacctttaagagctgtaacactcactgcgaaggtctccggcttcactcctgaagtcaacaagaccacgaacacaccggaagaaagaaactcaggacacatctgaacatctgaaggatcaaactctggacacaccatctttaagagctgtaacgctcactgcgaaggtccagggcttcattcttgaagtcaccaagaccaagaacccaccggaaggaataaattccggacacattgtgatttgtacagctaggaaggatgggctgggtgagtgcaatatgcccttcctgtgaacatgcagaacccagcgaacaacttgtagcactggaagttgaaggttggtggtgacgagtagttgagtagtgtttcatgtctagaaagccaaacctcacagaatgatctcagaaagataaaaatgagtaaaattgaagatactctcctattggccagttaaatatatagaaagagaatttaagaaagagcataatccaagttgtctcccaggaagtgtggatttcatggaattctctgttaattcaagcatatttatggagtatctgttccatgtttatgtcaggcgctgtgccaggtgccagcactgtttggggatggaccctattagcataattctgcagatgagcccagattactcattacctaacaccctggtgttctctcctccttcctgggaaagcagaaagagaaggttggactatgcagagtggtggcggcggagcatcagttgagctcttctctgcatgaagcccgcaccttcaaaggtagaactcacttcccatcagagaagccacgtgtatatggattcaaactaaaagctttctatcatattgccttttaacatttcttgcggcttttagaaaggggagagagaatcggattgggtgacaacacttctaatggagtctttacttttggtggtttctgaaggaaaaaatcattgtacatgctcgctatgaaatgctttctgtcttggaatgtcagttggctttttttttagtcacagagactcatttacagcactgtgatcccgggctctggagcaggtggaccgagggttccaagatcatttggcatggcctctgccgtgtgctgaaatttaggagggatggttcccaggcaacaccgtactacagaagagtcccacagtggttctaactctaagtgggctagcatatgaccaaataactaaccagtctcttattgctgggttgattctctgtccagctgtccagaaccctcttgctacccccacctccactgagtctctgggagagtttgatcaactttgccttgtttccaagttctctttcgcagtgaacatcaaacacatttatcaacactaattacaaagttatttctgaccccccgaagaaaagcttagaaaatacaagaaagcacaaagaagaagaaaagcactattcctcctttcatttttctataacaaatattttccatatgatttttttttctttttttctgaatcagggatcttattgcacacactgtgctgtaattacttttcactcaacagtatatctggaacattttccccacctttatatcttttacaacaggagttttagagctgcacgttattctattgtattgatgtgccttatcctatagaaccatgcccttttgttagaagtttagagagcttttttccccttctaacatttgtctattatatagagactatcctttcattcaattctttttgcacatctgtgattttttcccccaggataaaattttcaaagtggaattgctgggttaatcaggccttttaaagttttatgggcttgaatcatcgacaattgtttgaggataccattggattaaaccctgtgcactgcagatggaggaggtgatggattctaatctttagtgatttgttaggtcaaaatggtgtctaattgttacaaaagtttcattgttttgataggtagggattttcaagtgttttactcttaggctcactgaatttttgtgtgtttccccttattatttttattgattactgttgtttttttgtattgtccattgtaattaaagtatcttttcattttaaactcttaattcacacagtaaattgttcacaggctttttgtctgactttggtatttaacaataaggttttcatttcatttttatgatgccaaatattttaaaaatcttttccagaatctctttctttttgattctttcatcctaagagtgagtaaatatgctcctatactcttttagttcttttaagatctaatttattaaaacctgttaattcccctaaaacttatttggatatataagaaacttatatatataaaacttatttgtcaggagggatctaagggccatttatgaaatttctttttcactgatttacatgcctcctttgtctatattatgtacatattttaagatttaattcattttctatttttttctgcctacctacttttaggtcaatgcaatcgttttagttactatgacttttaaatagttcatattcccttgggttttttttcttttgattttgagagtatttcttaatttctacctttatttctgctttttaatgtgtgacttctctcctccgattatataggtgaatgatttttataaatgttcccagagtgcttaagccttcattcccagctgattcaccctcatattgtcctaactcacaccatgtaaggcttctgtttcaggacaggggcctctactaagtgccagttaatacatattaatgtgaaacatgaataattgttaattatcatttctcttacactatttttaaaaaaatcctctccattcttactatatttctagccttctctctcttcctaattgtaccatgtttgtctctccacctatacagttaaatatcccagactcttgaaggagatatactttcccaagttggattatatttcttttttcatcctatgggaattggaaagtacccatgtgttctcaaactttctctaaagacccaaaagatataaatctgagcagtaatctcaagctataatttgccatgcagttccatttgatctcagcagagagaaacaaatactgttctcctaggtccacttccctgatgagtgtctcggtgatctatgctagaaaccaccatctccttgactataggggttacgtacaaagaaaatgtatttctttccagcttccctccacaagttgaaagacagattttacattagaatataatgtaacactgttgggggcctacaataaattaaaaagttagcaaataggatttgcaagtaagttttccatccctttagtttcacatttcccccgacactcgacttttcagtgtcccagagtgtctatcactgttgggtttctcttagatgctgtgagttaatgcagaaatgatctaagaagcaatgtggcatcgtggttaacagcaggggttggtaagttggttctgtaaaaggcagataataaacgttttttgctttacgagtgatactccctgttgcaactacccaactgtcattgtagtgaaaaataatcatgcacaatatgtaaataaataagtatggctgtgtttctacagaactttttactgaaatgggtgaggagctgcatttggctcatgggatgtagtttgctgctccccaattaacattgcaggttttgcggccagcttgcatgttctggctctgttcctcactttctaggtccacaatgttaggtaagtttcttagcctccctgtgccacagcactacatccagagtgaggataattatagaatttactgtaaagggtcgttatgaggcttgaatgaattcatgcaaataaaccccttagaatttatgtgccgggaacatcataagccctaaactaagtgtttaatgttgttttcactagggaccagtatacttcatagatcacagataaatttgtcaggagaagaacattttaagctagttttaaatacgttattaataaacccttccttttctcttaatttctattgtttagaccttggatccactcccagccctcccagcatcacatcttaaaatgtgaatgaaaaagtctaactgctgcttgctggtgttttatttcccaaagagaaaatcacagaggcaacagcagtcttcccggggtactttataacacagaaaacaaggtctgctttgttatggctacagagaagctcatcccatacatttcttttcacatggtttgccagtccagatctatttactccatggcttcctggctaattatttccagcatggcactgattgagctgttaataaagtgtgaaggtgccttgcagatatattctcagccttaaagaagcggatctgtgttgcaaactgcaaactgctgtgtcctccgatccccccaatattctggtgatagcatctccaattgtaaaattaatcaaacctttctcagtgacagaaatgttaatttaaaatttttgtcacaattaccgagagtgttattgcagcttctgacttgtaattaatttcttcttccttctctccatcactgggttagactcctttgtaatagtgataaatgaaatagctgcctgaccttttttttatttaaaataaattactttacaagaaaaaaattaacttcaggtaatcaacaccttcagataaacaggggaacatgggacgtaaggtactttattgtttctctctctctttctccctttttaatttgtgtgtcttcagtgattgaaatgacaaatggtgaaagggtgaagtgagtctacttttatggccgtgttcctgtgtggaactaatttaggttgtggtgttggtttttatgagaactggggaacactaacaaaatcagagtatgatactaaggaaaaattgtaaattagaattaaagatcacctcaagggggaaagaggaagcaaaatgttgtctttacttgagcaataactggaaagtttagctcagtatgaacctgtcccttgctattccaagtgtgggctgcagaccagccacattggtaatatctgggaacttgctagaaatgcagaatctcaggccctgtcaccctagttgcactaaatcaaatgagacccccgtgcaatttatatacgtactggaggttggaaaacaccatgggcccagatttagagttggaatgtctgtggaggcagttacaagtgaggcttgtcaacaaatagcaaagcttatggcataccaccactgtgcgaagagtaagagaaccactgtgcatatttgaaattaagaacatgcacaagggatgaaaaaggatacttagaaataggaattgcttttctagtccccctgcaagagggccagatttggtacaactatcagaattgtcagcttttgaagggcaggaactgttcagctgtatcacagtaggaggtcaccaaacatctgactgagtttgcagaaagagtaatggaatcgactagaccccatggtaaaaatccaaagcagttggttgaaagatgtaaaatgctttcgtagcgcaagtgggtttgtttgtttagctagagtaattgtggtagaatgaatgaggatttcctgcttcttgaaattgaatgatggggaatgaaagaacatttcctggctgaggtgctagagactaagaacgacatgtaggtgtagaaacatttattgtggacctatgacagtgatatggcctccaccctggagcaactcatagagtctgagacatggtagggcaacagacttagtttctttctgggactcactttatcacttcctttggaatacatggcttttctcattaatcatttggaatacatgacatttaagctaaatatagagcttaaatattggattaataattaatatttagcttaaatgtttacctccagatctcagcagaagtaaagctaatgaagagtagtgcaatcctgggccacattcacataaatttggacagattgggacttcatgacattactagaagtgtgcttatttgtcatgttgctattaataatcaaagcagttaaaaatgctggcttttaaaaccccatcctcagcagagttttgtgaataaggattacatgtgcaatgtttttctaggggaagcaagactggcttgggatctttgttgtgaaaccctctgtcaaaattaattaagtgaatcgtgtaattaaaatttatgcatctagatggcccccaatggcttgtttcttaatatgggattagttctgaaacatctgaaatagcaacaaaaagactaaatggcattttttgagataaaacttaaagcagctaaaaaacatttgatttaagtgtatcttaatggcagttttggttagtatgggatacttccctcctttcaacttttatcgtattaggtgtaaatcctcagattgggggctctagagacaacctggtattattttaaaaactaggccacatcacaaacaaacttattacaggtggcgaagctggcaggagataattaccagcccctgggttcacacggaggcactcgccggcagattgggttcctctggcccttgataaacagagttatcactaaaatacacatgctggtgaatatattatttcattcaccaaatagagatttcaaatgactttgtaacacgccaaattaggttaattatcttataagagtgttttggaaaaactctaaatgtgctgtaatgaggctgcagaggccttggtataagccggcctttaaaaaactatttatttaaaacttatgttttgctcctgccttctttatttctccttgccttgaagggctcccagagagtgttccttgtggcaactttttttcctccagcccagtgccgctttcacagagaccaagaccctatcagagttttacccctcctacctcacccgtggtaacccaccacgtgtcctgggagctgttctaagccaggactcaagcatttcgggttcttgagaattgccacccatttgtcatcttgatgttttgataaagacatctctgttcagcagggagcctcataagggcagaagtgttatcggtggagggtcttgactacgtactgtccaagtccttggcgttttgaacaaagaattgaacaaaacgcacaacgtagcggagaaatgaaaaggaggaacaaagcagagaaagcaggaatttatgaaagcgagaaagcactccacagggtgggagtgggccccagcaagcggctcgagggcccaaagttttctgggctttaagtaccccatttgaagttcttatcagctacccgttatctggatgaaggatttggcctgtggctaattaaaggctgaagtgaattggtgccctatgcaaatgaagggctggtccctgcttggccctgccaatccaaggcactctccctttccatccgagccatggtagagtgagagggctgtaaggaaagtagcctttgatcctttgctactccgctggggagatggggtttttcctttaggttcagctttacaaggtgttaataggccttaggtttcctgcccccagacccagatgttgtccttttgatccagctttgggaagtcagtagaacttggccttagattctctgcccccagaccttggtgttttctcttttaggaagtcagcacaaattggccttaagttctctgtctccagaccctattctcctgcctcaggagctgggttgtgtttatcagagaatcctagcatggggtgcaggcttgggaaacaggctgcaataatacctgtccaatgaatgaatggaagatgatgaaatctatcctgtcaccagaatgtagttggcactcagagctggtggaatgagtgaactctgagacttctcagcttagaattccctgactctcctttctacaggatagagacagaactttctcatatcaccttcaaggtcttcctgggcccctttcatgtcacttcccaccttatattctcaagtttaaccacattgagattttcaggaccttgaaagcatccagtctctttgccgttagagttccaatacactttttcctttacttggaataagtacctaacttccatcactaccctttacattctgttgctggttaatgcctcccttcacaatttgctttgatattacttctctgggaagcccctctgagctcccaagactgattcaggcatccatttttttctataacatctcatacctgctctgcacccccaaattacttgatactttcatctcaaaaactgtgaaatcatttaggacagacattgcacctgtctcgtttactgtttgattcccagcccctagcagagtatcccgcacacagcaggcactcaatttgtgttgaaagaataagtcacccctgcttggttgtaagataagcagattgtcatcaacacagagaacaaggcttcagatttaatgacctcattaacagtggaagattaatgctggaagaaccctcctgaaaaagggttgagatatgtatgaattggagatcctgccattgcggcagctgagaaacatctttgtcctgtgggagcagcactatgtcctgaggagcggcttcctggaggacttgctattgggtatgtcagggccccaggctttttgagttatacagaactctagtacctgaagggccagggttctttgaagtctgcaaagtcttggaattaaatgagaaatgatgtgtgtgagtggcagaggttgcccatccatctccaagtatctccccacccttcctctcccattccccaagaaatagaatttcagttttgcctgcttacctccctttttttttttttttttttgagatagagtcttcctgtgtcgcccagtctggagtgcagtggtgcgatctaggctcactgcaacttctgcctcctgggttcaagcaattctcgtgcctcagcctcctgagtaggtgtgattacaggtgcacaccaccacagccagctaatttttgcatttttagtagagacagggtttcaccatttggccaggctggtcttgaatgcctggcctcaagaaatctgccctgcctcaacctcccaaagtgtctcctcatttttatatagaaaaaggtacaaggaattgcctaaattcctctgttggtgagggattctgaatgctttagtcttagagatcttagagtatatagaatatttcattttacccattggctttactactggaaaatcctttgctggatacatgtgagaacttatttcaatcagtatatccaggaacatctctaagtttgtagagttgcctggaaaataagaaaatgtagcaattgctggcattttctgggcatttcttatgttgtaaatacatctgcattcagcagggagcctcatgagggcagaagcaaggtcttgttcatcagagaattgtagcacaggacacatgcttgggaagcaggctccaatagtacgtgtccaatgaatgaatggaagatggtgaagtccatcctgtcaccagaattgactcggcactcagagctgatgattttagggatatctggaggttttagggatatctcattttaatacacatggcagcctactattattgtctccattaccaatgaggaaatcgaggccccaagaagagacttacccaatggtaagtctcttgtctcttacgagagcatgcagcctgtaagagacaaagtcaatatttgaactgcctttctttcttttcttttctttcttttttttttcgagatggattatcactgtgtcgctaggctggagtgcagtggtgtgatctcggctcactgcaacctctgcctcccgggttcaagcaattctcctgcctcagcctcctgagtagctgggactacaggcactccaccacacctgactaatttttgtatttttagtagagacagggtttcatcatgttggccaggatggtctcgatccgttgacctcgtgatccaccttcctcagcctcccaaagtgctgggattacaggtgtaagccatcgtgcccggcctctgaactcactttttttctagagcccatgttgttattctgtgtatatggtaggtgctcttgctggcctcatttcacagatgagaaaagcaagggtcagagaaattaactaacttactgaaggtcaaccagtcctcatggttagcagaaacaagcttaaaaccacctctgattcccatgagtgctggtgaccaccagactgttttgcttcctggcagtgttctgcgtctggtagcttctggttcagaaccaattccttagaaaacctgctggggtatctattgataacttcctgctttatctacacaagtgctataacatggaatgactcctgtctgggagctgcttttgttcaccattctccacaaagcagccaaactgtatttacttcccagtcccactgcatctgtgaccaatgtcactcccagacggcatactgatggcagtagcttttgtaaattgtcctgagagaagctagtgtggtctgaaccatccccaggtgtgaatgttggtggaatcattcctggagcccctggaggtattttgccataaacctctgaacatagaactgaacttcattcttcactgtgcacaatgaagaagcacaatgccctaaagctgtagagtgagctatgacactggaccaaaggatctttcaacatgtattttaatgatgtagagtttaaagttttccttcttacggcaggatctgctctccaaatcactgatcttgtaggccaaaagtggatgtggttcaactggacttggtatgtctcaaaccattagccatcactgtggagtatttctgtcccttgctggccttcttgacaagactttttgtttgtttatttgagtgttaagtaacattactggaatgtttgactagttattcaggtagacaaatgaacagtatttctgagcgctaaacaggatgaaaaaagtttccaaacactggagaaaactattgaaaatttcaaggttttgggcttgaaaaagtgtgattaacttcatgaaaacagaaatcctacaggtaatacaattttctaagtacaatagaatttatcaattaaagtggaaccaataagtaatgtttaaccacatgcaaatttcttataagatcatttaagataactactaaagtaagtaggagctccaaactgagattacttttacagagtcagagaattgctaaggaggaaacattgtgactgaagccaagggacctaaattcacacaattaattattccagtactatcttcatgttacaggaaaacagtaattctggacatatgcaagtattattcattaaaatagagaactatgactcaatatgtatagaatataaacacattttctagtgttgaaaaatatttatagtctacaaatgatgttatatggtatatattggtggtgttctaaatgaagaaaattggaatttcttttttaattttttaaattttctgaatatgtaatagttgtacagatttatggggtacatgtgatattttgatgcaaacacatgatgtgtactgatccagtcagggcaatcagaatacacatcactctaatcatccatcatcaatccaagttgggaatgttccaagtatacttctccagtgattctgaaatatacaacaaattaatgttaactatagtcatactattgtgccatgacatactgttctgacacaaaatatttatgtgaaatattgtactcatatatgtaaaaagcacatagttccaaacaccatttaatacagacaaaaatcctcaaaagttacaagaatcctgaaaatgtccgatagagctgatagaaaaatatggaaacctcccaggaccagaagtaaactaaaagaagtatcaataggagaaatcagagaagccagtgcccgctttgggtactggttgatcacaaggaactcaaaacagtggattttccagtttgcccccagcagcaggacagtctgcgtggcctttttctcttgggagattcttggggagagctggtcctgtgaaggtgctgggatcacttctgatgcctaattcttgggaaacagcaaagtaggaacagtgagttccaaactttcccatgagggagctcattttcttgtataatgatgcctaggtgggtcagctggccttagacctggacatttccgtcatgctcactgtagaggggctggaagaacactgctggaggccattctgaaagaaggttctctccatcctgtctgagattctgggagaggatggagaagcacgtggacctgggacagttctccatgaaaggatgaacctgctcttgtacctcagacagacctgcaaagccaccctacctgtgctgtcatgctcagcagctcacctccatgttctggaattccaagcaggtactctgaacatccttcaggtaatagcagaacccagaatgaagagaaggaaagctggccttggagaaaagaaaatcttgacatgacttttgtgcctgcatggtatcgatggtattgctagttttcatttaattactgttcactgcaagtcaacaatgtgtcaggcacggaggacatagctaagactcttaccctgagggagtcagacaatgcacagagaaaagcacaatcaaatgcacaagtcccctcttatcctccatttccctttctgcagcttcacttacctgcaatcaatggcagtccaaaaatactgtgttgaaaactccagaaataaacaatttataggttttaaattgtgtgccattctgagtagtgtgatcaaatattgtgccatcccactctgtcctacctggaacataaatcatacctctgtccagcatctccacactgtctatgctacctgcctgttggtcactttgtaccatcttggttatcagattgaatgtcctgctttcacagcacgtatgttcaagtaaccctcatttgacttcataatggatccaaagcacaagagtactgtgtctaatttatagattaaacgttaggtgtgtatgtataggaaaagacatagtgtgtattgggtatggtactgtctgaggtttcaggcatctgcttaggggtcttggaatgtattccctgaggagcggggacaattgtaccaggctttgcactgagctaagtgctgtgaaggacaaaggcgagaagtagtgataaaatggggaaaactaattaccaaggatcattagaaatggactctttgaagggattatatttatgcaaaacctgagagatgaaagaaacccaagggaggcagttgttccaggcagaggaaacaacatatacaaagacctagaggtgagaaaaagcttggcatgttctagaaactgatcacagaacacagtggctagagagtggagaatgaggggtggctgtcatatgagataatggagaagtaggcaaagtctgggttgtggaagaccatatgggtattgctgtatattcaaggtcattgggaagccactgaaatgttttaggcagagaaacacaatttcattgataattttaaaagcttcctctagctgctgtgtcaaggttagattgaagtgaaaactacaaaacattgctgaaatttaaaagagataaataagtgcaaaaacatattgtgttgatggagtggaaggattaataattttaagatgacaatattacccaaaatatctacagactcaatgcaagtcctatcaaaatgccaaattttttgcagaaattaaagtgatactaaaatttatgtgatgcaaattgaagtgatgcaaaattcatagccaaaacaatgttgaaaaagaagaaaaaagtttgaggactcacactttctgatttcaaaaattacaaagctacagttgtcaaaacagtgtggtactggcatacggacaggctcatagacacatactcacatacacaaacatacacataccacatacaggttgagtatcaaaaattctaaatgctctaaaatctgaaactttttgagtgctgacatcacactaaaagacatactcactggagcattttggattttcagattagggctgctcaactggtaagtataatgtaaatgtcccaaaatctgaacaaaatctgaaacacttctgttcccaagtattttggataaggaataaacctcagcatatatgaccaagtacgtcaaaaccatccaatgggggaaaatcatcttttcaacaaatgatgcttggaaaacttgatatccacatgcaaaatagtgaagtttgatccttaccttgccatataaaaaagttaagagagaacaaagacttaaatgtaagaggtaagactataaaactcttagaaaaaaaaaatagaagaaaagcttcatgacgttggactttgcaatagttttttggatatgacactaaaactacaggcaacaaaagaaaaataggtgaattggatttcatcaaagtgaaaaactttcgtgtatccaatggcactatcaagagagtgaaaagataactacagaatggagaaaatacgtgtaaatcatgtatctgataaggtattaatattccaaatatattaaaaactcatacaattcaacaacaacaaaacaaagccaattcaaaaaatgggcaaaggactcgaataaatatttctcaaaagaagatatgtaagtggccaataagcacaggaagagatgttcaacatcactattcattaggaaaatccaaatagaaataaagtgagataccccttcatactcattagaaagctattagatggctattagaaaacaaaggaaaacaacaaaacctgctagataacaggtgttggtgagaaagtggagacattggagcccttgtgcattactgttgggaatgtaaaatggtacaactgttgtggaaaacaggatggcaatttctcaaaaagttaaatatagattactatgtgatccagcaatttcatttctaggtatatacctgaagaaataggaaacagggactcaaaagattcttgtacaccaatgtttatagcagcattattcacaatagccaaaagttgaaaacaacccaaatgtccaccaacagatgactagataaacaaattgtggtacatacatgcagtggaatagtatccagccttaaaaaagaaaggaaactcagatacatgccacaacatcttgagaacattatgctaagtcaaataaactagacaccaaaggacagatatggtatgatcccacttatgtgcagtacctagaacaggcaaattcatagagatagaaagtagtagctgggggtatagctactatttgtttaatgagtactaagtttcagtttgagatgatgacaaagttctggaaatgagtggttgtgatatacaacattgtgaatgtatttaatgacattaaattgtatgaatagtaaatttttgttatgtatattctaccaaatggaaagaaaaataagattgaattagaagaggaaaagattacaaatgggagaagcagtaagaaatacccttatgcaggagctaaaggaagagatgatgatatttgcattagagtgaggacagttgaatgaagaaataggtttctgtgggagggggtgggtgtgatttgtagggatggaatatcacccatagaggttgtgttttatttcccctttaagctaaaataaaagtccctcttactgtaaggtattgtactttgggaaaattctgtaactttcttttggcccagggagttctcatgacagtgtagcttcatttcatggggctaactctcacacctactttgactcaccatttcctttggcgtacatattatagagatttctgggaattcatcatgtgtgccttttctttaaaaatgtgtaaagaaacgttttgatttttaatatcaggaggcaagtcaccatgtgattattcggattacaatggctcaagtacttatagacatttttccaatttagataaaaagtttatttggtgttaagtttccttaatttactttattatagtcatttatatatttaatttatacttttatcccttggacagcccttatagccttggtttacccatctggtgccaggaaaatcagttagtatctagcattagtattaagggtctctgactatatggccttatttgcaaacaaattctcccaagttctcagcaaacatttatttttgagaaggcaagttagcaggaaagataaggatttttacgtagtatttgcattgtcaattttctgtttagaagaggtagcattattttgcatcatcaaagaatgaaaaaacagcttctatttcttatcagctcatctctcagatttttgtaaagaaaattacatttgaaagcccactgcaaagtttccagcaaatggtcacaatttcctaaagtgatagcttttctctctatgccaagagaaaagtcagagtggatgttgtggaggttcattttggaaagtgtactgctttcaaagcttgttcattaaagcacagagaaatactgtaatggctcctgtgcgcagattggaccccgctttatgaagcacaacagctgtgttggtattacagcaggcagcaatgcagtgcttaggcgtgtgattaactgagctgaggatcatgggctgtggaggcagcgtctgcagggccgagaggctgagcctactgggtaccataactagtgaccaacctcagaaaagagggccagatgtgttagcagggaccccagtccacagatactgggtttcaccataaaaaatacaatccctttcaaagtcagtgaaaagtaagatggggaggagacaaggtcgtttgaaaaagattttatagtcattttctttgtcacttttataataaagcaatcttcctaacctttctcgagtttatggggaaaatattctcctactcttgtaaaaataacagtagcagtggtagtgagctcccaataaatgttaactcatgtgccaagaattgtgataagggtcagttatggactgaactgtattcccttaaggttgatacgttgaagccttaatgccgaatgtgactgtatttgtagatgagacctttaaggaggtaattaaggctaaatgatgtcctaaggatgggactctaatccaaaggactggtatccttagaaggagagaaataaatatcggatgtctctgtcgtctctgtctctgtctctctctctctctctctctctccctccctccccctccctccctccctccctccatgtacaagggtagctgtttacaagccaggaagagaggcttcatcagacatcaactctgatggcacctcaatcatggacttctggccactagaactttgagaaaataaatttctgttgtttcagccacccagtcagtctgcggtattttgttacagcagcccaagcaaatgaatgcaggatcctataaaacttgtctaatcctcatagcaaacttatgaggcaggttttttttttgtttttttttgttgtttttttttttaagataaggaccttcagatgctcagataggctaggtaaattaataagcatgcagttcttgcacctggatggctcctactctgaaacattgtgaatcacagttttcaccaaagaaaatagagaccttattttcttgcattaaatggcttgttttctgtcatgatgctggaggtggtgttttaccttccctctctcaccatcacccagcaaggcagccagtacagggtaggtcctcataactttattgaatgcaagatgtagaggcactaaaaataaaagtgaatgtggagtgatttagatcatcaaccatttaattgtattgatttaataattatttccttctgcttaaatcattgccaagatagaaaatttggctgcatatcatgagtaattgactaaatatatcctcaggagaaaatatgattcttcagcaattcattatgaagaaaaaggtacaaataaaagataaaagagacaaccactgctgatggttttaggtaggaaagtggccattagtatattcctcaactaagaaaaggaaactcatctatgtcgacaacatgttctggggtagttgtattcacttaactctagaattcagctgtagaattcagaaatccttcggtccaagttattaggtattttttacttcctggtgactgacagtagtggatcctaaagccttggaaataaaccattctccaggatacattgttctatttcttccttaaagagggttggccattccctaaggaggaggtaaaagagtctattctatgcctttcttctcagttctggaagaaatttttctcaagtcaaaagcatatgtacatgcctcttgttttcctttgaaatactgtcaccgaaggagataaattattctcatctccttagacgttggtaaaagatgagagagctacacacattaaaaagaattttcagtctttaagaccaaattcactgaggtctccctgtttcccagcacatggtcctatattatcacatgatatatgtgttagtctgttttcacactgctataaggaacagcctgagactgggtaatttataaaggaatgaattttaattaattcatagttcagcatggttggggaggcctcaggaaacttacaaccatggtagaaggcaaagggaattaaggcatcttctttacaaggttgcaggaaggagaagtggcaagtgaagggggaaatgccctttattaaaccattagctctcctgagaactcactcactattactagaacaacatgggggaaactgcctccatgatttagttacctccaccagcctctcccttgacacatgggaattgtggggattgtgggaagtacaattcaagatgagatttgggtggggacacaaagcctaaccgtatcaataggtgaccagtaagagttgtttaatgaaaagaggcactctaaagtaatttttggtcctaggtaaactggacttcagaaatcctgatatatgaccacgcaaaatgaacaaacacgaatcatcttttagatgttgactctatcgcacttaggtgttttgtttaagtaacaacaagcctctcccacctccagagagaggctatagccaggagacctaaagcatgaatgttaagctataaattatcaaaggaagcatatttacatatctaataaaacaacaggaaccaccttatagaatcataatgcaacatgagtttttcagaattcattttttaaggggagagaaatctctttcctcactttttcttccaattaaaagtctcttaatcctttctctgccttcaaagtaatgcttgagttttagaatcccagagcgagctggaagggagccaaaaggaagcagaatccaacccactcattttacaaatgaggaaaacctgattaactgatttgtccaaggtcacatatctattaatggcatgctcaggactgaaacccagatattctgattcccaggaaatccgaactttgcttccaggcttgtaaaggtgtaattgcctccatcatctgaaattgagatatgcctaatactgctgggttcagtctcttctcaagatggatgtgtaattgtctaagcatcatctgttattctgccaaagattcaacacagtactcagtgggaaaccagttctaatttaagtcagagcaaacgatgtgtttttttttctcttgcagggcatgacaagtttcagaaataatgagctctactcactggacttctctttggctttgtattgtacattagaatcattcttactaatatcctctaaggagctgaagggttacatgagcttttagagccatgttttattattaggatcattcataccagttatgcataagcatataccaatagaaataggaatttgtagtattgtgtggtgtgtttaactgaacgtggagtggtgtactgaggtttgagatcatattaaagtgcaagccttatttttatgtaaaccctttctggcctgaggcacttttctcattacaaccctccctgctgcaatctcctaccataaagggagtttttgctcattgaaaaatatcaaaaagtagatagtttattaatgtcaaccatttgagcagctggttgaaatggatgggtggaaacaaacgctcctgcaaattcttccatccatggaaagaggcacagccccttgtgttatctaagccccacactgccacacaaatgccactaccccttcctgaacactttcccttctgtgtctgctgtgtgacctcaataatgtttcttgaccctttggaggtacagactctatccatcatctgacaaaagcccgtggacctgttccagccccaatgcacatggttaaacacacccaattttgctaataatttaagggggtcttaatgaccctctggagtctttcaggggccttaagaaatccttgttaatgttctttctttttcttataatccagaacttgtaagctgtggggaaatcatctttgatttcttatttgaggtttaaaccatgaacattggtcgacatctgacaacaacccacagcaaatgaaataaatttctcatcaaacattgtttcgatgcacactgcatatatcatgctagacaacctgggagtacctgagatactcttacaccgaagcatacagtttaggtggggacaaagtgaagctaatataaaatggttgattgagcacaaaatggtaagccccactctgcagggttcagaagacaaagtaatctcacagggtcagagcaatcaagaaaagtctttgcaaaggtgggaggaaataatcacttgaagcataaataagccttaggtaggtggaggaaagatataaggatagggaagatactttgagcaagggagcaaagtatgagtatcactgttggagagaatatcaaatcaaatgagcaagaatgtggacagcaatgagtgtatgtagcaaatttttcctattagtaagcatcacctgacagatgttcaaagatggtggttctataggtctgcttctgctgaggaggcatggttatataaccgatcaccctaaactggccccagtttggaattacaaatatgtacgtcatttatcgaatgatgttatgtattcttagctaaaagatatgttcatttgaacattttttcttcaattcttttcaattcaatgttattttctgggtatcaggagacccaatatgtctttaacttctgcttcaatctatcttttctcttttttatacttttttccccgtgattaataacaaaagttagacttctgtgtattcgtatgtatacaccagtgcatttgcatatccatatacatgcatgtatgtgcaaaaatatttgttgataaataggacaggagtctgaaggtcttattctaaagtgttggcagcagttgcttctgaggactaggattggaagatgctaatggcaagaagggaacattatttttagtcaacatacttctgtatggtttgaactctgtataataagcagatattgcttttgtaattaaaggaaaagagaaaaaagggaagaaattaaatttgacatccctacaagtaatatgaagccctttcatccttttgaaggtatgaagaacaacaattgtgcctccagggaaatttattttatcagaacttgtatgattttttaatcatgtaatgaagcagcttgccttggatttccagtaggcttgctttgtttacatatgcagatctctgctaataattgacggtaactggaagtgctgtttcttagactggcatctcatccccacactggcatgcacatgtgctggttgacattagtttccctcactttctgtacaactaggacttctgtagctgatgtgctggtttttccgtaatctcccttctcctccatcctgtgaccaggattgtgtttcccatacagtgccctagggccacaggatgagctaagaaaccatgacttttttgtacccggctgagctccaaccttccttggggttctaattattctaacgtcgtaccccagaatttgatgcaagttcttgatttgatatgagctaactagctgcacagaaactgccacttggtgtgtagggggtgtagcgtacctacacacatagacgggaagtacaaaaggctaattcaagtattatgatcacagacattcatgggaataaaatattttatgttattaacatcatggtgcaaaacagcaagtaaattgcaagtccagtcttttgatgacggtgtaaaatcacacatttaatgagaaacaaaaatggtgagagtacacacaaacacttcaagatgctgcatgaagaaggcagggatagagatggtttttattttatcaatattaaattgcttcatgaagtaaagaaaaatatggtgagaagagactaaccatatgcgtttcagggtgagtgtgataactgataataatgtagtggcagcatgcagagtagtcaagagcatggcctctggagtttcaaattctgactccttcccttatgagctttgtgaccttggtcaagttacttaacctctctgtgcttgagtttccatgtagataaaatgaagttagtagcagtaactatattatggaactaagaggtttaaaagaggtcatgtatacacagcatttagagtggtgcctgatatatagagggtataataagaaataaaagttagtaaatataggtagcatatattgagttcttcctgcttgccagacactgacctgagtgggttacagggttctagtttattctctggagccctgtaagaagtcttatgattgttcccgtttcatagatgaggacaataaaactcagagagatggagcagtgtgcccaggatggctgtagaagcaggatttaaatatgagcaatcaggtcccagagcccctgcttccaactattatcatctaccgagacaggaaggaaggagttgaggaaatttcacccaagccaagcatctagtccatggtttaaattattgtaggttttatgggtgtggggtttccttttgggggtgatgaaaaagttctgtaactaggtagtggtgatggttgcacaaaaatgtgaatgtacttcatgccactgaatggcacatttgaaaatgcttaaaatggtaaatgttatgttatgtgtattttaccacagtaataagaaataattgtaagtacaaggacaagtagtcccttcccaaagaattatatgttgactgttaatctttgtagccaactgctgcaaccagggtgcaccaagataacagcccattttcttcttgacgttggcctctctttctgaaacaggtattctcctagatttattttttaaagtatccaatgcagatcctgggtgtgattaaatctccctgtggcaaacacagagcaactgtccctcctataagttgagaggtgtaattgtattttcttcccggatgataaacttccttgcatattttaaatgctaaagtgaggagcagaaaagcagagagtccaggagggattttgtttttagtgagtaataattttacaagattaaggcaatgtgaagtgaaatgaaattaaggagaaatactaagaaatataaactaagcataatttgtctttaattttggtgtttattgaagtctttgaagagcgcattgactagttgctggattaacaaattttgtttttggaattattcgtagttgcttagcactgaagctttagaaaaatttaatcctttagtgaaaaggggctaacaatcgacagtatgctgtggtcatgttgatttaattatcaaacagaacaaaattgttgattacttaatgattaatagtaacaaagagatattaagggcagtcttggctggggattgagtctttaaaagctcgtttgttttgttttgtttgaaaatgtttaacccaaaaacttggataacaggctgaatcatggaatcatggaatttacatctacaatatgaatcacaacattttaagagagagatgtgtgccctgtttctttattttggccatgaagatgagggtgaaggtatctgttttatttaaagaactggtgttattcacaaataccttgagatagttaaaagaaattccatttcatgataaactaatgcaaatggaatgtttaaaaatagatttggatatattatctaaagtgtgtggtacttttactgacaaaagaaaaggtcaaaacaatgaaacagactcttgttgctacacatgcctggtcatggagcctcaggcttcagctaaccctccaggaaagtggataccagatcctcactctcaccctccaaactgtattttattccttaataacttaacagaggaaactaatgggatgatgttatcagctactccattctctggtttcaaggaactgtttggtacctgggagacatgatactgcttttgttgaattttaaaatggtgggttggctggagatgtcaggtcccaaggatttcaggtcataccatcctaccctataaagatcaagccaagaatatatagatgttctcattttaaagacttggtgttatttatagcatttcttcttataacatttgattaggtcaatttgctaattttagaaatggggaatagtgaagctaagcatttaactttttttcagtgaaggatttgaaataaggttctttagagacttttgttgttgcttttgttatatttagcttagtagacttagaaacatgaaaaccttaattttgtataataaagttgatttgtatcctaaaaaaagaagtaccctggcactgccttcataaattaagcatcatagtttttatagcttgtgaaagagaaaatgagcttgtgcaaaggtgagctccagaggacaatttcttgagaatatcatgtggcttcctccctcatgtctccttttcctgaagctgccattaatttcataagtgaagaagtgaagtacatagggaagtatggaaaggttacaggccagattttaataattgttttattatattttctagttttgtgagaggaagacatgatggcaggtctagctgtcaagctgcttggatggccttggagtcaggtaaatgccaaatgacctttctttacatttactgatggggaaactgagaatccagtcctcccaagactggaggatgtaggctgtaaaacagtccagctgaagagtggttactattttatttattgtgaaaaacatacatgagaagctgagttattatttttacttacttggtttcattcattcccaagatgataaatgttctgtttatggaataagattttatgcttttggaggtttgaatcattgactcctaagtgttgcaagatgcattgcctctcaaaatttccctgatattagtgtgatttggatcttaatctgacagtctggaatggttacattggtcgaagatgccaatctctgctggaaacatggtaccataagccctagtctgtcattagtcatgccttgatgatattaggacttgtgatttctattcaaatagtgtaagatacataggcagcagaattttactgcatcttttatcatagatattgggaatggtgttcattaaaggtaaaatatgtcacatctttagtcctgccttctgtcttggtaaaggatatttggtttttaaagattctctcctgatcccaaagcattttgtcagtgttaatatggaataaaaggtttcttattaaggtaggatggagagacctattaggcaaaaatcttgtaagatgaaaaagaagagagggatatgtcttatccaagaaagcagaactatgtcctagggctaaacctgggctgtcttttcctgctctgggtttttgttaccattactttggcataagaggttagggcctgggtataaagcgattgtttagttttcttcaagggactgcaatggacgttcaaaaacttatttctctgtgagctctaggtcctttatttgtggtctcagtgccttggatatttctgttgctcttttgagaaaaagtttttctattaaaaaagtggttagttgccaaggctggtggattgcttgagtccaggagttgtagaccagcctgggcaacatagtgagactctatctcttttagatttttttaaattaaaaaaagtaattagtttgactctcccctcaaacaatcacacaagtgcttttctttgagttagccactccacctcagtatacaacacaagtgttttatgcaactttcccattttgtcacacaggatattaagaaggcttgtacttaagggccaagatttaatcaagtgattttttaaaacacactcaccaaagatttttttaaaatgtaacctcctcctcctccttcccctccctccctccctccctccctccctccctctgtgtgtgtgtgtgtgtgtgtgtgcacgtgtgtgtgtgtgtgtgtgattgccttgatctgtgctaagccatttagcagttttaccatgattactttagcatcaaaatgtaaaggccaacaaagtgaaaaaggcaataatttcttaggtttatcatgacaattgttttttgacttattggtttccctaaaggcctccttggactctacttcccaacctctggcagggttctgtgggccataattcgagaatgggtctagaataatgctttgttctggacagcaatccttcatgaagttttttttttaaccttcttattttcttttattattaactctaaacttaactaagtcatcagctgtcctttgactcccatcctaagtgctttatctgcatgaaatatttatctctaagtgaattgctcagcagacattcacactgaaaaataagttaagacagagattttctgaggagaaaaatattaaagcgcattgatccaaacctttagtgactgggtaatactactgtgatctaatcacagtggcagaatgttcctcaaacgtcgaaacgaacagctccataattttcacactgtgctgtgtgacagatggcaaaaaccattttgattttccccaatatccaaggagcagcaagcagagcctgtgcctcccactttgctctctgtctttgtcatctccagtcggcctgacagcacaccgatttctacctctgtgatctgttctttggatgacgatattttcaataactatttagtataaaaataaaatgtgagggtcccatcaaataaactaattaaggcttagaaagtgtcaaactccaaaagccgggaggaacagatgaggcactgagtatgagagtcacacagacctgacaactaatgtgttaccacggcaacaggagaatcaatatccctcaactgggcagatagttgacagtaatttttgctgggtcagagaattggggagagtgaaaacctccttctgctatgcaaataattgctatctcctttataagcaaaaagcttctgaaggattttgtgatcaaattctgaccaagtctagtagaagctgatactcacggtcctggagaaggccctcaccatgtaaaagggaagcaattgagtctgtattttctgtgatgcattcactaccttttttaaaatcaggggtaaagacatgtgtttcttatgttgtaaaatgagtgcctaatgtatgactgaaagctggctcatttgatctttttctcctgtttatgattaaccgtaagaatttctgtgtatgatcttcaggactgtcttgtcacataggaaattagtatcatcctggatgtggtggtcacatatactttgaacatgcagtcatggctaccagagagattgggttaaaccttgctttgtgctttgtggaagtttgtcgtttagcagaaaggaaacctcgatgttagcatctgtttttccaaacatgcttctcaggcacagcatattccagagccggtggatatataataatacctgattcagcagaacaagagatttaatatcaaactcatttaaagaaaaatgatgctttctgcagtgcataaaagaatggatgataaatttcaaaataaagaataaaaatattgttattctctatcaggactccttactctgagagtccatatgtccctttctcccttcttccttctctctcttttcctttcttttgctcttccttcctctctctgtctctctccctccctctcctttcttttctttccttccttttatttctttccgtctttctttcttccaacataaacttaatgaaactgttttgaaacactgactaaaagtcaatatacaacttagttgaataaagttccataatagcttttttggtaatggttcttgatggtcctctcttactaagtgccatgatatgatatattgaaattaaaatatgggcatgcaattttaacacaagggcattaacagaaatgtcattcctaacaaatgaggcattgggaaatctgccctataaccagagaaccatgcttatttttgccttttgctataacttataaaaacaaacctcatgatgtaaatgcctgtgggttagatttccagttgagaggtaggcgacaggcttcagtgggggaatggggagaggcagtttttgtttgtttgtttcagacaaaggattcctggcctggggcggtccagctgcagctgctgtcaatattgaggcaatcagactatttttctaactagatcaaaacagaaaattctgcctgcgattcattatatcagaatggaggaggagggagagggtaaagggaggaaggaagggagagagaggaaggagggacgaagaaaggaaaagcatgattgttaattcttctgaaaattacttgcagggttgccactttcaaattagaataaactctatctgggtctgtttgcaagataggagcctaaaggaatgcgaaaatagtgcaatgagtctctgctgtagaagtgagaggaggtggtgggatctgggttttttgagagagagaactgcaaacctcaagtgtgactgaattcaaatcaggcttacaaggcgtgcttggtttcttatttgctgattacgtcgtgttctgttttttcctcccttggtattttcatgatggtattgttttgagaacaagactttggggtcaactagttggctgttcctgttggtatctgggtaaaagtaatcctggccagcgttggttttttgttgttgttgtttctttctttctttctttctttctttctttctttctttctttctttctttctttctttctttctttctttctttctttcttttctttctttcttcctttttttttttttctcctgtactctcattctagccccctttggtgcttggacaggttaggatctgagccttccctgggcctgtggctctcccagtctattgatactgactcatcgcttgggctcctctatctgggtaacttgagtatattgggggagggtggtgggggtgaagtcctttttttctacaacctgcctttccccacatgttcacttttaccttttcagtggagaacatcggcacaatagatggggaaaaaataagaaaaataaataaacctgagttactgaatagaatggctcttggtatttactcgtgttcaggaaatatttgccgagtgccttctccacggctgtgccaggcccctggagatgaacatatcgagctggcaggcacagcctgtaccctcaaaggtcatagccgttgaatccttgagaagacactgatcctggcattttgatattttgcttaaatgtacacttgggatgtaccttaagttattgcttattttatgggatgtagcttaagttattgcttattttattcttttttaagatgtttgagtgttgtgtgtatgcaacaatcatgtagaaaaatgttaacttattgcattggaaatatggcctaaattatctggttttataacatatccaatatgttacatatactacccaggagaagtattattaaggttaagaatagtaatttctaggttgtatgggcatggtcaagtggtcaggtagctcacaaaattaccaaactcgggctcagggtagctcctcctctttgagttagattagcattttgggaatcattgtgtatctttctcagggttaagaggattgtcctaaatccgcattctccaatatagcagctaatggctacatgtggttgtttaaattttaatttaaatgaatgaaaatgtaattgaatttaaaatgtagttcttcatttgtactagccagatttcaagtgttcaggagccacctatggatagtgactaccatattgagcagcatataatatgggacatttccatcattccagaaagttctatcagacagtgctgttctaggataccttcattttttcagccaacctttcctgggcctctgctatgtgctaggtattgtcctggtgaaactaagacatagtccctgcctctgtgggtatttggcccggtgtagaagcagatatttatagataagacaagcagaggatgtggtatcatccatgcaggacaacagcgggttgctgagatatgctgtaggacagataagctgcttagattgggtggggaggaagggctcttctgaggagctgactttgagctaaactctgaggcatgaggaggagccaggcctgtgaaagccacaaaaatatcgtttggggcacagggaacagcagaggcaaagccattgaagtgggaaagagctgagctttttcatagcccctcctcaggcacagaactctgaggactgtggaggagtggtggcaactgagagactggcattccttcaccccagtcactgccacaccaccctgcccaggatgctctgctttctttgcaattagactctcttccaactcgtgttataacattttctcagctgtgacactaggcctgtcccctggcctcagaatgaagctaagagaagctgaaaagaatacatttagcgtctatgaagggtacttatgtttcagggacctggtacactgtatctgattgtggttaacagtgggctgtggaggcttctcgtgctcataattgtgattgtctttctttgcaacacttcttcccattccaggcctcactgaagcctctctaggaagctgggtgtccattccagagccatttcctggtctctcagcagagctttaagagctctgcttggctgaattcatctcccagattcaaggcactgaggcctttgactctggaaagtgttcacacctcctacaggctgtcctcccagaattctcagaagcctgctctggagagctccttcccctctggcaggtgcagcaggccatagctcacattggcactgaacaatggcctttgtgtagatctccctgtgatctccagaaaccctgatccagctcttagggaaggggaagcaacaagacttagcaaaatccctgctgcatccatctcatacagataattaataacagcaatccttggaaaatgaggcttaagcaatgaaatccttttctctttttcaatgagagcggtctaataactggggctttgactgttgtttcctgaggaaaccgtgcagtgatgaaattaatgatgtattaaaacaggtacataaaaatgtcacagtgttgaagacagagcaaacaggaaggtacttcagaaaaaggtccccagttatcagaaaagttatctgaaaatgaaacactaaccaagcaagaaaatactccctgagcatcccgtgaagatgagtctttctcactgttcttttctgcatcccacgtgcataatgtaaatctaactaaaaagcatgcaaaagcaaagagtgtttttgcaagtgattgatggattgtattgccttctatgttatatgtctctaacagacaaatgtatcatttgtatttaggtttactctcttgtttatatcaaatataattttcaatgggagagagttaatcaaataaccttctgaaatggtgttttgtgatatggaaaacaaatgttatttaaggagatgattcttttcttcttaaaaggatatcacataaccacaaaataattctctctgtgattacactgacagcactgtgggtgacattgctgggggctgggggtggtcaatctgatgaaactccagtcatttcacaagctgatgttggctgacaggtcttcaggccagaatttacaattctacaaatatttaaggtgcttcattagtagaatacagggaagacaggtatagaaaggaactatgtcatggatgggttttatttttctagtagctttgttgaaatgtggagaagatgatagatgggaaagctagtcaagacaatttgtttggatttggcattctttataagggaagactgtgtgtgtgtgtgtgtgtgtgtgtgtgtgcatgcacacacaggcatgcgtgtgtaacaaaggtgttcattacttgagaaccaaagggttcagctacctataaacagaggcaacatgtccccaagggaagtgaactctgcagccagttggttcgtctatgtgaaaccaattatttttcccttcaatttgattgatttttttattggactggattgtatcatatttgccttaataaacaggagctcataacaatgcatttaaaatctgtagtgatatactcaccacctatatttactttgtaaatatgtgaaaaaaatctacagttatgagattaatgacacagaagagtctagcaggagtatgtttttattttgaatagagcaggaaattttatttaaaggtaatgtaaaattaaaatgtattgagtggaatcgtcttcaccatgagtcaacttatttattgggatgaagatggcttctctgtgtttcttgaggacatgttttccttttgtgtatacttgagtatttagaggagacttggcccataaggaaatatgaaaacataatattacctttgttcagtagttagtaaaaccatccgggattattaataattttataggtcctatgacttttcataaaaacatgaatgcttcctctttcaccactccaatccccaaccctggcaactttttagtttttagtaattgtcctatagaaatttgagaagaagttgtatcttcctctaaatatgtccttatgtggaaattgggacaagccattgtagatgtaattgattaaattgaggccatgctttagtagggtgtgcccaaattcaatatgactgggttcttatgagaagagaaaatttagacacacacacacataaacacacacagagaatgctatgtgaagatgaaggcagagatgagggtaaagcttctacaagccaccagcttctcttcacagtcctcagaggaaaccaaccctgccaacatcttgatctcagacttgtagcctccagaactgtgggacaacaaatttctgcttaagcacccagtttgtggcactttgttaccgcagccctagtaaactaatacagactgcaaatggaaaaacacaaaacaattaaatcaccactgcttttcaccattttcacttggtggtggtgtgttaccagggtagaaaatgaatacttaccaactaaccaggtgctggcagtatttgactatttaccaatgtcaccatagaaaggcagagttattaaaggatctgcaatcactgggtaattcagctcttgacattgatggatggaacttggcttttcctctctgccatagctgctgactggataaatgttttattcatgaggcccaggacaggaagggatgccaaaggcttaagaatattttaagaaactctgagatgtcagacaagtcatcaggaggtgttaagcaaggaagctgaggtgctacatcgacccagctggacaataaaccccatgcaaaggctggaagcagcaacagtggtcttgggaagccattcaattttcttttcttttttgtatcttatatggattcgcacccatggtcacaattcagagaagcaggagttctgactgtggtttgagggtgtccttgtctcacatagaatccaaggtaataccatttagagtagactcatagtcattgaagtcctacctactcatggattgagattccgaatcattcttctgcattggcaactgcctccgctgagggtgtcattgaaatgacagcatgtagcttgagcatcaagtctcatgaggctcattagctacacattttcattacctattaacaaaatgatatttcaaattatttagcacaacagattattttatgctgtgaggagaaagggcaatttaagtgtagaccggttgccaatgtgactcgttttttctgtataaaaagaaaagtattttatacaatagtgggttctaataaaaaatgtttgcactgactcaggcatccgtaatgatgggaattctaggtataggtaatgaattataatgaaaatgctccttgattctctattatggccagaggattttaattttttataataataaacttttaaaattacttggaatcacataaaagaaccaaaaataaagtgtggctggtacatagttgtcaatctaaacctcttttaattgccaaggaaacatgcacctaagtccaaatgagtctttccaaattatataactctgctaaaaacatactgggttaaaatgaagaattaaaatataaaactcatcagtggatgaaaaacaggcaagtactaggtatccattgtcctttatgtttggggagtttcagtgttaaagaccctaagaactttcccttgggtcctggttagaaaaaaataatcaaagagcagaaactgacagtgacaccactctgagacatgctatcaagatacatcaaaatatgccactatattctcccctttctatctgtcaaagccattgattattttcaataaagaaaaccagtgacagttgctggaattgtagaattcagcaaacgaactaggtgatgcctgtcactctcctctaaatagacaagaagaaatttactcactgcatcagaagcatatttttggaagcatatttaaatatggcttcataaagggtaaaaataaaagacagaaaaatgaaatctttattataccccaagtcccttttcctaagctcattggagttttccatgaaactgcttattttatgtccccctctcaagataaaataaaacaaaaataaatttaaaaagcaattttaagccctttcctacttcttggttaggtaagacatacttgggtaccttagagttttcatataatcagtgactgccatggcctcctgtaagtgcagttgctggtcactttggtcacaggagtcattaaaggtttgggttgtatgagaacaattgagtaacttgcttataatgtgatcataaattcgttggtcatctggtatcccaagaggaacagaatccaaaagaggtttatggaagccataaagaatgattaacacagagaaactcttgccagtagcagtagtaccccactttcaggggcaacaggggtatggcccagaatctgggagtagtgacatgacacaggtgtgcaggctgaaggttaagggcagtgtgatacaagtccacatcccacccacctggcttccatttgttcaaagcctagctttacaggccttccctgtaattcttgaagagttccccagaattctctccaaaaattcctattctgcttctatcagccagagtctagtttttgttttatcttattttttttttcttgcaactaagaaacctgactaatgaaatatgacttcattttgcttgcaaaacctcagaggactcacaatatgctcaggttagagccaagctgttaactagaacctaccatattaatatagggtggcacttggttgttttcctctgtattgagttctgtcaccccaatgcactcagtcaacactggagaaaaatgaaagaagtttgttcactataatacaaaattcctagtaataacagcagcagatagggccaacatttgaagtcttagctgtaccaggcactgtgctacaagcgtacatcaatttttaaatttaatcaccccaacaattctaagccaaaaatactgttgttactatcataccatttatgcagaaactgaggcacagagaggttatgtaatttgctaagtgggatatagcttggaattcgtgattcaggtttgaataaaagagctgtctgactcagaacttgtgatcctaaccttgcatatgcttaattgttctacttctgattttttaaaagccatacgatttcaaaatagtcctaacaaaaccttaagagaaaataaacctgcaagttatttttactgaatcatgcataagacaactccaggaacaggccataacttcataggtttaagtatgagtttgaaaggaggcatattggcttatcattttaattctttttatgataaaaaggaagacaatgatctttggaggtgtgggaggacaggatcaggtaaacagggtatgatttacagtttttaaacacttaggtctacaaattatattagctgttgccacctaaagttatctctgcagccacctagagccatactctgaatattagtttttctgagataagtgcattggtttcaaaaaaaaacagacactggagctatttgttagtacactgtgcttccctccaacttgcaaaactcagtgtcccaaatctactgttagccacatgcatgagcagctgcatttcagaagatatttttaatacataaacaataatttttctacttgaaattcatagtaataaaccctgcttaagagtacgatttaaagctcttcagaaaaaaagatgcaaaggattaacaatgcttacgtggagaataagtctattaaaacatactggttagcatgctctgatgagcattttcaaagaatttcctaatgtttgtttaggacaaatgctatttagtttatttataaaatgttaaacatgttgtaaaattagaacatagaacccttgaagattttccatcctcaagctaaccaaaaactttttcttaaagtgcccttaaaaatattaagaaacaaatctcttatggaaatatcaagaaaagttccctggggaaaaaccagcttttggtctaagaaagactaaatgcaaaatacacttatttctgaaacatatggtacacatatagttaaatgtacaaacttatatgtaatatataaaatgaaatatagaaaactgaaatatatctatacatatacttaatatgtgtaaatacatacttaataaaatattcttcaagttaaaaattaaattggtaaaattatagtagattataactggtttatactgtttgttgcttttctctcattataactagttctgctcttggatcacattacaccattaaatcttttgataattcgaaaaaagtattgcttccagctgctgctgaaaaaacaaactaaagaggccttctaaactggtatgaaaagagttatcaaacaggctccattaataagaattcccttttctgcacttgcatttgcttgttgttgttttagatttagcaaaggcaaatccctaaaaggctaatagaatacagcagtaatccatgattatcactaatacacaaatgccagactttgtgtgtgttaacgagagctgactgatttgccttctgtgagtgctgtgacttcagtcttgcatttttcgctctcgtctctgttatgtcttccttcattgtgcatggaaattagaaagctttcttttctacttttacctgaaaggaaaaaaaagtaaagaattttcaatgtaagcattttagacttaaagacatcaggcttgaaagaaggatgttcataaaagaactaaacctttgcataattggacataattctgtggaatttgttattccagatatggttaaaaagtgaaggttctgcaaaaaagttaggtaaatacctgggagatggatctacaatgagatactgagaaactttgagctgtttaggtaacttgacttcgtggatgcaaacgacactcctcatcagaaaaagaataattcactgggcaggcagaccattagtctgacttgattttccttcatttattcataaaatatttattgaatgtctactacatgccaggctttgtgcttgacagttagtgtgtgataaatgatacagacattttccctggctgaatggaacttatatttggtggctgagagtgattatgatattatgtgctgaatgtaatagcagggtaagtagagagtgctggtctcaaggatctgggaaagtttccaggaggatggaattaagctggggtttaagggaataagaaatcagcaggaaaagtaaggggtgtggctacaagtgttcattctataccaagagggatcatgtgcaagagctcggagataagagagaccctaggacaaccaaagatgcaaagaagttccatacaactgcacctggttcaggattaatacactagacactgtttagggtgaagtaatgagaactgtgaaaacatactgagcctagcctttgcccaaaaacagagggcttccataaccaatgacggagggcaaaaacaagcgaaaagaggccaagaagctaggctacagcccaagaccaaaggagaaacagcatacatgttaatggctagaagctttaaggcagacaaactacacatcaaagagatggatatactgtagtggacaggggaaggccagcagtgatagacaatgttttagaaaatagtgaagactgttttgaagtagcatccattcagaagtaggtctcagcagactgacatggtcgatgatgatgaacatggaaaaagtattattattttgaaggtgaatggggttgagtgtgggtaaaatatgactttcctttaggaggaaattaggtaggttttatagacagccttttgtcagttctccaaaagtttctactccacataaatttaggggtcatgattagatacccattattgtcccttctacattaataaaggctacttatttttagaaagataagttgttttaaaaaaattaaataaaacatttcaacaatactaacagaatggtgaataacatagcaaacacccatgtgccttttacccagctttattaaatttgatttctaccaaatgtgcatgaggtatttctaagaaataaaacattacagatatgttaaatttccatgtataccactctccgattccatttccctcttgccttccagagaggaaagttatcctgaatttggggtttatcatttctgtgtatatatatttttactacttatatatccggaaagaatataaagaattggcattttaaaataaatgtgtataaatgacactgtactatatatgtatcattctgcatctactcagcattatgtttttgagagttatccatattgacacaggaagctctagttgatatttttgaactgattaatagtatattatatctttagtatatcatattttaaagacatgtatgttgctggatatttacattgttttataaatttttgcctttacaaataatgcttgaatgaatttctcatcttgtgaaaatgagagagtataggttgggtatgggttgggtatcggtaagtagacatgaaattggaattgctaggtcacaggaatcacccatgtacaattttactaaaactttactgctttccaaagtggtcttatcagtttacactcccaccagctgcatacagggctcatattactccatatctttttcagcacgtagtattgacagacatttaaatttgtgtcaatctaatgagtatgaaatggtgcatcagagtccagctggaacactctcagtctttcaacagaggaaatttaacacagacaattgattagacagatgatagactagctgagaaaccaaactagatagtgaagcaacattcacaatagtagaaggccatggttaacagaaatcagaaactagggtcacctgtctgaaattgacaccaaagggggatgcaggaggcgaggtgggagctggacacaacaaggcctccgggggctcatggaggctgccagaggtcctgcaggaaacaaagtggaaaggggaagaatgcctgtgttctccctctgtctgtcgttcattcctcccccagtgccttccactggccaaacttaacctggaagcctgaaatagttacatgtgatatgaacaagagcaggggaagagaggaaaatcagtatgaaagttgattggaacaaatggcactgcattgtagttttcagttgcatgtctctgatttagagtgaacatttttccatctgtttgtcgttttgtttccttgcctatgaattgttatctatttgtttttatccatatttttcctattggttgtctgtttttaatttgttttagagactcattatataatctagatattaatctttgtcagttatatgtagtgttaacattactcgtaatctggctaatttccccttttgtttagcctcttttgtgatatagaagtttgaaatctaatatacagatttggtcttttaagcttaatgcttgtgttttagtcaagaaaatccttccatattctaaatcatattcctttatattgccttgtaaaaattctagtttaactcttgatatttatgtctttaatgcactggggtttattttgcgtataatgtgatatagatatctttaaaaaatttcatcccaaaaggtaacctcttattccagaccatttttaatactctattttttaaattgctacccttgtcatatattcagtgtccaggtgtgttggctccttctcatgtgaatctatttctagaatctgtactatgtgtcattggtctagtttacacccatgagcaacatgctgtcttaattaatatatcattaaaatctgattcccagcaagactagtcccccaacattgtcttattccaaacttgagcaggctattccagatttttcaatgctttgtatacattttagaataattttatgaagttccataataaaactgttaaggttttaatttatgttttgctgaacatagagatgaatatgaacaaagctgtcatttttatagttggatcttaccattaacatggtatgtgtgtgtgtgtgtaattcgtttttacaggaaacattttatatatgttttataatttcctccataacattattacatacatttggttgatttttttctcagcaagttatagtttggcttatcattataagtggcatttttactgagttgctgctagtgcagaagaacacagagaattcttatgtattcaacttctatctagaaaactcgccaaaatgttttattagttctaactttgtagattcccttggatggtgatgaaaacgaaatcataccacatgtgacttagggtagatttatttcttccttcccaaccctttcacttattttttatgtctttaccacactggcctgaatctatggaacagatgttgtgaaagctgtttgtccttagctttaaaaggtattctaatattccgccattaaagatgcttttggctctagggcttttgttaatttctttatccaggtgaaggaaggtcacttgtcttgtttgtttgctaaaagtggtaaaaattgaattaaataatcggttttaattgaattagattcttttcctgcatctactgatatgatcacatggcttttctcaaacagtactttgaagactaatgctctgcctgagtaaaatctgaacttgaaaaacataaaaatcaatactgcatatttcctttggacatagacagatgtaaaagcattttttaaaggactgtgagacaacgtacaaaactgattataggtggcacttttggagagggggagagaaatggaaaggaggtggatggggataggagtgatgatcgtagaaaaagagcacttggcttcctctgtaatgttctaatacttttttaaaaggggagcggtgtttacattcaactttcatcgttgttttaacaatgtatatatagaaaaaacaagtgtatcaaattaatgatgataaatttttagttacagaaatatggatgagtgccactcttttctttgtacttttctataactattttccaaaaacaaccaaaaagccagttagaaagtattattcaccttattagtgacatatggtttaaattaggttcaaaatttcaaatgtagagtgaaaaagttgaaagtgtgaactttgtttctttatattcatcatcaatcaactaagactcatgtattttaagtaccttattgagtatggttgggcgagataattacatagacccattatctaatagtatggatggaaaatatagacagccttttcaacgaagcatttaagccaacatgtgaatcgaaagtgaaatattgctatcacatacggaccaatagcaatggcttttcttgcttgcgggcaatatagacaccaattcctatttgttttatataattaaacagtatatactgtacttctctctaggatggtctcattctctctaattttcatgtttttctctgtttaagacccaggcactcaacaatcaagcttttacctcatggatgaagtaagagtaaaatgacccagcataaaaatttgagtacctagtgctggattgtccaactggctgacaggctgacagtgtgagcctgggcttagggggccagtgggacagacacacatgtgcgtgcacacacacacacacacacacacatatgtatatatgtgtgtatatacattgacagttttaaacaagagatttcaaattgaaagaatgcaagtaatcataatcagaaaactcagagttgggcttatgtttatgctctgatattgatttaattttgaattacgtggtgagggtgagtggatgaggagaatgagcatcaaagtcctaatattttgggcagctaaccacttaaattggccctgtgaacacatctcccaggagctttgtgatagaatttttgtgttttcatataggtgactcaaccaggcatgatgttcataaactaaagactgggtgaagcatagctcaggaggtgtgtgtgtgtgtgcgtgtgtgtgtgtgtgtgtgtgtgtgtgtgcgtatgaaatatgtatttaatcctgaacaaactaaaaaaaaaaaaagtcagaccctctctgatgaaatatcccaaatgggtaatagatggaagattagcctgcaaaggagaacaacaacaacaacaacaaaaactacacccggggcatttgagatctggagggacaagtttgaggctgtgaaggaggcacctaggcagagggaagagagaagcaaaggctggaagcagaagccaagggtgtcctctctcagcatttctcccctgacgtccacattgacatttctgagcttgttcatccttcttaaacttcctcctttaatgatgtttttcaacactaatctctatcgtgttatggtcagaataagtcaaagggggaagagagacggaagattgggatattagtgactcaaaatattggatttcttggaaatcttgcatataaagatggtgggcacataggctttattttttatcggaatatgcagagaacatgaaggtacactttgcacactttgttacattgtttgaagttacaaagagaaaggaattggaaattgttaggctttaataatgtcgggaaagaaaattttattgaaacaattctgaagaaattagagatacagatttatcttagctaaatatcaagataatagtatttttcaaataccaccaatggctacttatgtgatttttttataaagatcaactcaggtgcttaagggttaggctttggagctagatttcaatgccagttccactgtattctgactcattctaacttgcacaagttgcttaatcaccctgagcttcagttttctcatctctaaaataagataatgatacctccctcataagttttctatgacgaataaatgatacaatgtagtaaaacttagcgtggtgccttatgcagggcaaagtacggtaaatggcaatggtgtagaggtggtggttattcaacattgagtttatcaatagtatattttgtgtatgtgtaagaatggtattgtaaatcagttgcatgtataaaaagccaaattcaatggcttaatgctggtgtatttttctcatgtccagggagagacatcctcgggcttgtatggctgatgagtaaatcctcaaccactcaagctccttcttccagcttcctgttctgccatccttagcatatgacccttatcctcacagtctcaagatcctcccaccccttctggaatcacacccctgctccctggaagacctgggccgacaaagtcagtcctttttcaccaggcaaacactgctttcctagaagctccagccggtgggcttcctctaacacctcatttgctggaattcagtcacgtgagcatccctcgtacaaaggagcctgggaaactattttttagatagtcctgcccccaaacaaagttgtggttctggcagtaagaaaagaagggaggatagatattgagtgagcagtgtcttccatagtttggcattaagaattgctgcctgcctgtctaaagtcttaaaaataggagagggaggaggggagagagagagagggaaagaagacattgcatatggcctggttcaacagaggagctattgtggcatggcgacacccagtatctctttagaagaaagcaacattaaatactaggaaagactttttagttgctcctaacatcctcctatcatagaggggagcgtagtgttctggttaagaacatagcacagaaatcaaacagtcatgacttggaattctggccctgaccctatttgaatgtgtgactttgggttatttactgtctctaaaatgtaaactcctctgacagcggagcttagttttatccctgctgtagccccatccactaggagagacctttccttatagtgggcattcagtattagttgaatggataaatgggtggatgaataaatgaacttctcagaatcctggattcctcagcagtaaaaggaattaataaagaccatctttagaggtaatcatgaagatattaaatgaaagaatatatgttttataggacactctgttgactccgttgttataaacatatagtttcactgggagcttcccgaaggttccctgaatctaagaggctctgtggaccatttctgaggacctcttcaggcagctattcatgtccaagtctgtttttttcttagataagccacactattacggtaacatttaagtttgttaatgtactcaaagcaaatatctatgtggtggatccctaaaatttattggatggagagatgaaagtatgtgtgactgtatttacacacacacatgcaatggtgactttattttgaataaaagtttgctgagctttcaatatcagctatttcagaacaggcttgttgctgattaagggttagcacactaaattaatggtaaattaatactcatttctgtgctagtacatgagaaagacaggaaaattagctaaattagatgtgggtagtgatatccatcatggccaagaataatggtacctaaaaggattttctgtgaaactctgcgtatgagggacattcataaacctcaaaactctgatgtccttatttagttatttgcagtggatgagtctttacaaaatagcggtttaaaagaaaatcccccttggtagcaggtgccaagcacatacaacatttaacgctggctgacttacagtgtttatgagaaaattctgatttaagattcagaatgacttcatgctggcaaagtagaaatcaccaaattggagtacaatgcaagcaacccataaaaagccaaatcactttctaacattcctaagctagttcatgataacccctcatcatcaactccttgttgttacagagtagggtttttaccccaatgccacagagtgaggtatcttttttgggaagagaagtacttgttcatgctttctaatttaaattgtttatcagttgggtgtaaccatgttactcatgcccatttaaattgtgttcttctgtggcaagaccttcagcaccatcacaatgcaaaagcaactgcaacaagcaactcaacaagagaatgatccacttctatgtaaaagatgatgccttacggaggatgttcttctatgttgtgtcattgtgaagagacttaatttccaaccccataaaacacagattccagaagacatcaaatggtacctgcctatccttctgagctcagtggctcatgggaccctctccagccaactctgatgcttgggtgtgtgggccccattgagtatatgtctgctttgtatttctgccttggcctttcaccctgctccagcttataatgggaatattgactgaccattgactaggcctaggcaggcagactttgcagtaattatgaatgaaagatgtcaggggcaaagcatctcattccagatatttctacatatagtcgatactgtctttcgtaagtgtgactgagctccaaatggcttgcagtcataagggaatgaccaactgagtagctattatttcatccaattgatgctatgctttttgtgcaaagggaaacaggaatgcagaagcacgcacattttacaccagcctggttcttgctttcaatagctgctgcaaaatattagctcttttccctaggaagccagctcctggggagaggatataggttgcaagtggaaaaccatgttaattttcaatagaggttacaaaagaatagaaattcctacccaaacttaatcgttaatgcttttacttccacagaaagatgagtgtttacttcccagaatctcttgaatctgctttagcagtaaaataaggaatatggctaagaaaataattcagattaaaacatagcatattcttggatttgtgcaacatgcctgagtctgggcaaagacacaaatcaaggcttcggtatgatgagtttcctggccactatgaagtccaatccactttcaaacagaggaggtgtctcctcacattctaggtgccattgtgtgtcaaagccactttacatttttatgattactatccaaatatttaccaggatttcattatttgcccacaattatcttgatgagaagagcttaatcattttaacagatagtgaaagcaattacttagtaccttctaaagcaatgtccagaagatgccagatttgaggagcagagttgggaggaagggaattaataccaggcaggtaaaattgccccaagagcacacagccaataatgggcaaaaccagaaactgaccccagagctgatacttctcatcactatgctctatagcctctccactagcaatactagtagcactgagattagtcaatagttgcagcagtaaagaaggagtaataatagcaacagtagcatcagccattgtttattgaattcttactaagaaccagatattgaggtttcatactaagcattttcatggataatcctttttttattaccaaaacaatcctatgaaataaatgctattatcctcattttacagaagaggaaattgaagctcagagaagtgagatttgctcagataagagatgttaggttactgagctgggatttcaacataagagtcagacttttttgcttgtgttctaaatgataccctgtcttccctccgtagagaaaaggagaaaggagacatcagctctgctaacatcataaaagggccaaacactgaacatggggatatttgaatgttggaatgatagagaagtcagatttcctatcaggtttggtttgccctctccattcaggagagtgctgaagccaggaactgtgtgagcctgtcccaaatgagcatgggatttctaggctcctcagacaggacctcaaaccacaggaataaacagatggtgatggattgatgcatatgcttcggcaaggcactgtgctgggttctataaggcaactgtcttctgtgatgcaaccctgtgatgtgttgaatcacactaccagtgaagtagaataatttatgactcagagatgctaagtaaccttgtgttctcccagtgagtgagaaacaaggggcaagatgattcataggtctgtctgactctagagtctgcagtactgggaatcaactctggaaaggggtccatgtgtttgtgatcctgctccccattccacagctgagcctgcatctcaactgtgtcattcccgtctttgctgttaacacccatttattaggtttctcagaacattgcaattgaggtgttggccaggactaaagtctcagcagaaaactcaactggggaaggatctgctttcaagtttactcagcgtcttagtaaaattcaatctcactgattgacagagggtctcattgctagctgtcagccagaggcggccctcagtttcttgacctgtgaccctctccataggggagttcacaatgcagaggcttgcttcattcatgcttgtaagggaaagagtctaccagcatgatgggagttaaaatcttatgtagcataattatggaagtggcatcctatcacctttgccatattctgttgattagaagcaagtcccgtccaggactaactgggagggaattacataaattcattaataccagaaggcagagttcactggggccatcttagggtctgtccgtcacaacagcccacggctgagttctgcagtgtttggaaatgcaacactgcacaataccttccgtcggaggagtgctttggaacagactttttgagtggctgctgttggaagtacttctacatttacatgaacacagaccaaggcaatccagcaaaatgccatttccttaattaaacagattaaccagtaaaccgaattgcattctgcatggtggactttaactaacaaggctaatgtagccggtgtggttctcagtggaaggcttccccagtctcttctctttcctctctctgctgaccccacttcctctgccattttctttgtattctgtgcctccttgaatttttcatctcatatttttctgcatcaagatgacagttttgtgtgtatatgaaatgttcgttttaattatacaggcttggtaataagtgtatagtcaggttggcatcagccttggatgcaaaatccttcctttcaactgattatatcttgaaaggatttgcagccctgggcacctagacattgtaatgcatcattgttcactagatggacatcaggggacaaaaattaaagcagaagcaggggacggtggcagccttggccctgaaatcagccaagatgaaggaggatcaagtgaagccaacaacttggagttggagggggagggtccaagtgctcagcctctggccttctcacagtttgatgggatgacaagccatggctaaaggtgccacgaggccttctcaggaaagaattaagaagtaggccaagcataaggtgttagtccctaatgcagtgcaggagacaggacctggcagagaaggcagaccctctcagaacagtgagaaatgaggagttggcagaacacatgccccaagaatcacagaggcttaggtaccccctctgaatattgactcctgagacataaccatgtggcacttagagagatccttgcctttgaaactgaaaggcaaaaggcctgagaatcaagtgctcagaccacagaagcagagtagaggtcagatccactgaatcttagaactggaaggaacttttgaagaacctctatatttagtaccctaatgtggcagatgaggaaactcaaatttagacaggcaatggacttacacgaggctgcattgatgaaggtgtcatgtgccctttgcacctgtccatttgcttctcttaagcaagtatcccaaagtgctgctgcacaagcagctccaccaactgggaatgagagaagctagtgttttgttttgagtggatgttgtaaatgggtctctagccacctctcctatgcatggtagagtgtgttacctattccatcagatctcccagtgaccttccctctgagagatttatacacctctgtcccatttaggaaatctctgtgacttgtttttggccaatgcaatgtgagtgtattaggctattcttgcattgctgtaagacaatacctgagaatgggtaatttataagaaaagagatttcattggctcatagttctgcaggctgtacaggaagcattgcagcatctgcttctgaggaggtctcaggaagtttctaatcatggcaaaaggtaaagagggaacacacctatcacatggcaggggcaggagcaagaaagagagcaggaaggtgtgacacacttttaaatgagcagagctcatgagaactcactcacaatcaggaggagagcaccaaggggaaggcgctaaaccattcatgagaaatccgctcccattatccagtcacctcccataaggtccctacctccaacattggggattaaatttgaacaagagatttgggaagggacatatatccaaactatatgagtgggttgaagtgaagtgtgtcacttcagagtcttttcctctgccatgagacaggcaagtgttctggtcagaggctgcctctcagcctggatcccagaatgaaggtgatatgggcagagctatagcccactgccgatggacattcggtgtgagccacgtttgttactgggcttattctggctgtcaccacagcatgatttggcctaccctcagtgacttgacatggtgggcaggctccatacactcacacgtatgtgtacagtcacctttcctcaggtccatggtctttctctaggttgcctccttttcctgtgtgaccagccctgtgaataacatcccttactcaaggaacctgggataatcctggccacctccccatgttccagccaagtcaccaagcgctgcacttcttcccgtaccctgcctctgccctggttcatgctgctcatcactgccttagctgccaagcgggctgctttgactccagtcttgcccttccctctccaatccagtcctcgtaggtggcgagagggagccaagcccactagaaggtttttaagagggttgcttattgcaagatcagcctgaatgtggcctataaagttcttccagcaatagcatccatctgtctctggctgtgttcctatcaggatgcatttcttccatcttgtccaatttctttctctctgtctctgttttaatttaaaaggccatttttctgcatgggagctccacctccaacctgcaccactcagcaaccagtcatccatcctctgccctgtcccctcatttacttgcctaactctgactcattattgggacctcagtttggagtcactttgtctaggaacctttcccagactacttgagtatatgctgggagtgagtcctctggctcacggcaccaccctatcctgccccctgaagctctgtatgaggctgcgcttcaattgacaggcgactattccccagtagactacactcaccgccaggtcccccatgccttgcaaagcagtttctggcacatggtagatgccccttgaacatttgctgctgaatgtttgtttttcatcttgaaggcaaaagaaaacaatgcccagacatgggagcaaaagaccttatcctaaaaccaaaggctgttttggatacaaaatgttatatttcatgtgaggaaaaaatgcagcattggaaagaactagaaccctcaaaaatacatgaaatgagctacgtatatcattaaacatggggcatgggtctgtctgttctgagtgtgcataaaatcacaaatttttcattgagacgtaaatatttaaaaacagacaaaaaaagtgaccgtgagtgccaggagagtttggctaggagtgcgaggtgaggaggggcaagtggtgaatgagagcgtgctggattctgtggtcccaggcaggctctgtgaggtgtgggtgtgcatgagaacagtgttttatttttaaagatacttcctcaagagattgttcattagggagtccaaccttttccttgctgttctctgctgcaaacatgacctgattctggagatggagtttggagggatgttaaaatctaagagtcagtggagttgaagaaggcaggagttggggggtacaaaaatgtcccacaggccttatggttgatgagtgagtctacatagttgtggttggtcttctgggcagacaaactggtgttggtaatggttttcattccaatggctctgaaggagtgattcttggtatacagtacactgatgtgcatttgaattgtggtctgtttctgccaccagagcatcgccacttgtgattggtccagagactaaggcagttagggaacactgagcctggatctacccaaattcctcaggtaggaggtggggttgccattttctaactctgaacaatcacatgcctctgcatgatactgatgataagcatctacttggacaaggctaccagatttaaaaatctttgttggtaggtagataggcaggtagatgtcttagtttgttttttaatgctatagcagaatacctgaggctacataatttatgaagggaaaaggtttatttggctcacaattctggaggctggaagttcaagatttggcagctacatctggtgagggcctcaggctgcttcaactcatggcagaaactgtgcaaagagatcacacagcgagagagaaaaaccagggaagccagactctttgtaacaacccactctcctgggaactaatccattactaagaactcatttagctcctgggagggcattaatttattcataagggctccacctccatgacccagacacctcccattaggcccccacctgccaacactgccacattagggatcaaatttcaacatgagttttggtagcgcaaaccataccaagatagacatacaggctgactgatagatggctggctggatgggatggattagcaggtggatataactatgcagagagatgtaatagaaaaaagaacactttataaggagtacaatgaggggaatatgttcttttacgacccttgtttgcaacttattaaaagtcaacatgctggttgggtggtgttttataattgcaaagcagaaggtctaaataaataggaagttctaccaaagatttaattaacctaacctgtaaaacctctttaattgatctgtataatcaacaaatgattaatacatcatttagaatgaggtgtcacaaaggggaggctgataaacttaaaacccctttgtctaggcttaagagaatttctcaagaagcaagagagctcatttctcctgtgataacactatttctctccacttataaaatgacatcagctgcataatgagcagattaggcacagaatcaccaacatagtactgcacctgctaatgcaattagccccgtgtgctttcctcctgggagaagcagacacaggttatacgcagaatgcaagggcagcacctgaactaagtgggctgctttgtccataacaacatgtatgtggtttggctgattttagagagcatgaaggaaggggaagaatggttatgattctctccccagaaccagtagtcctttcttcatgtctgtatagacatgcataatatgtcaacctgaacaccttccttttgtgtgaaacacatctctcctgcttctttagggggtcgttttttccgtactccaactacatgattctcataagggcttctaaacacagtacccactctcaggaatgggcacaagattcaagcgggccaatcatagtaggcccaggccatgagtcaagccaattagaattcttctcaggaaatttttaagagggtgtcactttttttctttagttgtatagctatgaggattggctatttgggagaacaaagccagcttgcagaaaggaacatgtgatggtgatactgaatgttaacttggttgcattgaaggatgcaaagtattgttcatgggtgtgtctgtgaggttattgccaaaggagattaacatttgagtcagtggactgggaaaggcagacccatgctcaatctgggtgggcaccatctaatcagctgccagagaagccagaataaaagcaggcagaagaacatggaaagactagactggcttagtctcccaacctacatttttctcctgtgctggatgctccctgccctcgaacatcggactccaaattcttcagctttggtacttttccgcttacacaagtggtttgccaggggctctcaggcctttggccacagactgaaggctgcactgtcagcttccctacttttgaggttttgggactcagactggctttcttactcctcagcttgcagatggcctattgtgggacctcaccttgtgatcatgtgagtcgatactccttaataaactcccctttttgtaaacatctatcctattagttctgtccctgtaaagaaccctaatagagaatagaagtaagaaacagctagaaaaagaggagtccagagtccagataatacttaaatcatcaaatctccccggcttccctgatcctttcctttctgagacttggctgctcagcatgtccagacctgtgcacttcttccggcattctttcagtaagtacttaacgttctcaggctgtctgatctaggtttttgtcattggcaaagaaatgagtcctaaatagcttttcttctttcacactcacttacctaatgagtaactgagtaggtaatgaatacctacttacaaatgcataaggcctcacatttgccctaaaggacctgatgctttgcgggggagactgaaagagacaacagtggcatagtttggttaggaggatgatgtgacatgaaaacatttgtcaaaacatgaaaacccagtttgggttgtgatacattaagttttctttctttctttcttttactttaagttctgagatacatgtgcagaacgtgcagttttgttacgtaagtatacaagtgccatggtggtttgctgcacctgtcaacccgtcatctaggctttaagccctgcatgcattaggtgtttgtcctaatgctctccctccccttgcgcccccaccccctgacaggccccagtgtgtgatgttcccctccctgtgtccatgcgttctcattgttcaactcccacttatgagtgagaacatgtggtgtttggttttcttttcctgtgttagttggcttaggatgatggcttccagcttcatccatgtccctgcaaaggacatgatctcattctttgttatggctgcacagtattccatagtgtatatgtgccacattttctgtatccagtctatctctgatgggcatttgggttggttccaagtatttgctattgtaaatagtgctgcaataaacatgtgtacatgtgtctttacagtagaatgatttctaatcctttgagtatatacccagtaatgggatggctgcttcaaatggtatttctggttctagatcctttaggaattgtcacactgtcttccacaatggttgaactaatttacagtcccaccaacagtgtaaaagcattcctatttgtccacagcctcgtcagcatctgttgtttcctgacttttaaataatcaccattctaactggcatgagatggtatcccgttgtggttttgatttgcatttctctaatgaccagtgataacactaagttttcttaaaatgattcttaggttaaatactttccttgtattctaccatgtgaattggtgttttttattaaaatattttaaattttttaaagctttttcagtcaaacaagtatggaaaatgtcaaattaaaccaaaataagtagaattctttgctgcagaacttgttgctgatgcactttggagtatcatagagacaaattgagtatgcagggattcccaaagttcctgaagcaaatgcatttttcttggaatgtctgatcaaatttcagagaagcagtgttgacttgaacacagtttgggatctccattcgatcattatgagctccccagtacttcctgaaagaatgttgggggaagcgcaccagtctggacatgctgagcagccaagtctcagaaaggcaaggatcagggaagctggggaggtttgatgactgaaatgttatctggactctagactcctctttttctagctgtttcttacttctatattagggttctttagagggacagaactcataggagaaaggtatatataagctctctactcgatgattatgagcttctcagttggtgtaggctaagatcctggcagaggtaggcatgggagaagctctggattagttgaatcccaaggcatcatcctctctctgctaccattgtgggaagggtaccagagcaaatcttccttcttgctgggattaagcagcatgctaagccctcaaaaggagttcctatattacaatatgaagagctgttttactttctttacgcctaaggtggcactacacgatgagcaatagatgtcatctatatggatgtttagaggcatgaaccatagaggaagatggcaaaagctcccactcttctttacctcctttgaaccttaaaaaaattccatagaagtttgcattacgattttccccttttcattgcaaatacttttataacaagatattgcttcaactacagcacactgctgggaaaaaactgcagatgggaaggctgaggctaaatgccactgacaggcaggggagcttcctgttggctccaacatttagctctgatggttcgatggacatttgagaattggaatttatgaagtagaggaatttctgcatattcaccttgatactgtagcatcagaaggtcaccagaatgcagcccccacttttaaggaagtggaagatgaaggtttccatttatactctggttcattgtctcaatttggtacatttttatgcttttgctacttattgatttgagcaactgaattactctttggcaaacagggctgcattaatgcgttaaaagctcattatgaggataatggacacaaagtaaaaaggaatcaaatgatgtgagtgttaaaggtttttccctagacagctgagaataaattgaaaacaaattcaattaaaataacattcagccttttttatttcttccatggagtgcttcctctgaaggaggtgcctaaagctaacatgctgctttgaagggctaccccgtcctgcaccagacagacgtgggaagaccaatgcagaacgtgtgtccatgatgggctgatttaggaagctgttctctaaagccacacgtttctgcctcctgcagatatctctatgtctgtttgccatatccctttctgctttcttttggttaaaaatcagaagacccctcaaagcaaggcaagcttcccatcatgtaataaccttcccgcatctcagccttatgccccaagctgaaatctgggtctatccttaccccaaccttcgctgctgctttagtttcacaagcgcagtcaggcttcctctatccacagggattttcaagccagccctagcagtcatgcagtttttccttccttttcttatttactgttctactctatcatttttattatgaaagtccgactccctcctttaagaagacaaaggatggagtggtgtattttataaggaaatgctcgctgtttcttccttccctctaatcactgctgcccttccacaggtaaccaagggcagtagctgggtgtggattgccagcctatacatttccttttccccacttccctacatccaacccatctcaaagctctttaattctatctttaaaatgtttttcaaagcagtgcatttctttccttctttcctagtcattgtcacccattaggtgtatttatttcctagggctgctggaaggaagcaccacaaattgggtgacttaaagcaacaggattatattatctcaccattctggaggctagaaatctgaaaatcaaatggtcagtagggccaggctccctctgaaacctgcaagggtgtccttccttgcctcttcctggcttctggaggtctctggccttacttggccttacttggcttgcagctgcagcacgccacactctgcctttatgccatctggggttgtccctgtgtgcctgtcttcacatgcctgcctttttataaggacaccaggcatttgttggaccctactccagtatgacctcatcttaacaaattatatctgtaatggaccctatttccaaataaggtcacattccaaggagtagggggttagggcttcaacacattttggcgggggaggaggggacacaatcgaacccatagcacaaggctacagtggactagcctcttactttctcagagtagaacctgcccagcagccagaagagttccttcaatttcatggagatccaggcactcttctccttaaaacccacccttacaaggcttccgttgtacctaaggtaaaatccaagctcctgatacagttgacaaggcttttttatctggatcccgctcagctgtgctgctcaaagcctttacctgtagcccctctcccttcattcagccccctcgccctcctccctcacgctcctcattctttgctgagttagccctgctcctccatcacatcatattttgaatgcttctccttcctggtggccttccctgacccctccaaaatcttggccgtatgtacgcagcctttttttcctctctcactctcctacgtgcttatctcacctgtactgatgtcatcctcagggcatttgtttaatgtctgtcttaaacaagtgttgacgaactagggctaatgggccaaatttggcctgtggtctatttttgaaagacccttgatatgagaatggttttttatattttttagtgttgttaaaaacaagcatacaaaaaatacaaagaaaatatgcttcagagactgcaagtggcctgcaaagccttaaatatttatgctctggctctttatagaaatgtgtgatgatccctggtcttacctactatcaactccctgggagccagaatcttgtctgttttatttgctgctgtgtctggaaaatcttgcaaggggtctggcacttactaagatccttgctagatatacagttgtgaagtgaatgagttattcaatgaatggttggttctcagtgactgttgatttaggagaaaccaatcttttcgtaacagccagagagacttctctggtagtatgtatggattttgataatctggcaattcagtcatttaataaatagtgaggaccagtgacattttagacattagttgagtaaccagggagggagactgagctcttctcttgggaaactcatctgaagaagagatgcaaaatgtgatgaagggatttaaccagggcatcacttgtgaaagagaaatttaaacagtgtattcctggaggctgggtgtgatggttcacacctgtaatcccagcactttgggaggccaaggagggtggatcatgaggtcagaagttcgagaccagcctggccaatatggtgaaaccccatctctactaaaaatacaaaaattggctgggcatggtggctcacgcctgtaatcccagcactttgggaggccaaggtgggtagatcatgaggtcaggagtttgagaccagcctgcccaatatggtgaaaccccatctctactaaaaatacaaaaattagctgggcatggtggcatgcatctgtagtcccagttacttgggaggctgaggccaaagaatcgcttgaacccaggaggcacaggttgcagtgagtcaagattgctccaaggcactccagcctgggcaacagagtgagactccgtctcaaacaaacaaacaaacaaaaaacaagtggatttctgaaggttcagttcctccttggtggtagggaagagaagaaggggatgctgtcatctaattttatattatcaatacacaaacactgttctcctagagacaaattttccccagatgggctggttgttgctttgcctctggtccaaacaggaccatctctcatgagtcattctcactttgttgccctcaaagtgcaggtagttgtggaaaaaaacaaaactttaagcatcctcaactccagcctaaatgagaaagctgttgtcctgtgcagcctatggaaactcttgaggaatgaaccagagaccgcgtcccttagtagacagctgagcagcccttccttatccaaccaccatctttcaccacaaggcatgtccttatggctgtcatttaaaatcccacctcagcttttattttttccaggttgctgcagttttaatgcctattttcagaagcaggatgaatctgagatacacaatctgccagttgacctagcttcttacaattcagtgattcatttcaaaatctctccctgtgaatcttgagaaatcaagcttaaggatagtgttaagttgtacagaaggtctttgttcttcccacttttggctaaattagaatcggtttgtcttggacttattctacgcctttctactagaacttaccgagatcttttatttcctaactgtatttaaattttctttttaatgtaagtccttgagagttggcttttgtcctccaaacaggtagtagcctcatcatacagctggaagtgcccttcttcccctcagttcttcctgcagctcccaacttgaagtccacccccctcctggaggccttccttcagcaccagcagctaaacacacctgtttttgaggctcccacgcctcccccaacaaatgaaaagccaaatcaagggcccaaatttgcagaataattaaaattatatcatttgtctatcacaatgaaagatacaatgggactcaaattcactgacacacaagaagatggagagttcattaaaagaacatgtagcatagaagctgagtcctgcggtgtggtggtgaggtcctggcacaggactgatcagagccgcaagtgtgacatctttcggtctgtaagttgccccctgcacctttgcaaggctccgcagcattgggaataggaggccctttgaaatgagaggcctggccaaacactgctgggttttctctgtgttcagtggatctttttccccattgttcaccagcacagtgtcctgttcatttcctttaaagcatatcttccaatttgtaactattttacttactttacctgtttgcattctgtgcccttcccttgcccccaccagaatgtaaactccatgaaggtggggtacatgtagtatgtaatgcagtctcctggtctccccagcagtctcagtgcctggcctcctgtagaccctgtgagagtgacagtgccattcgcagggcctgttggtggtagggatgggtaggtgtgagcagtccaccacacctgagggcatggaagatggtccgctagtcctgccgtgttgggcagtggtttaacaccaaggccaacccccagtctggcaactgaactatttcatgctgtttatcagcagtgcccctcctcagctccacgagctgcatgggtctgtggttgagctaagtttattcagtttcaataataaatataaataaatatgaagactaaataaatggataagacttttgtcccttggtctttgttttcctgttggtctctatctctttcatgttctcatatgactgtactgacccatccctgattctcgctgggttcctgtttcccagaacctccttctttcactctagccatcactcatctgtgatctctcaagttggatccccattgtcagtaccggggagcctctgcttgtgatcataagactccatcatgtcaatgacctctcatgctcttgcattacggtagtccacccttatcttcaggtgaccattccaagacccccagtggatgtctgagaccacgaatggtacaaaaccctgtatacctatatatactatatttttttcctatacatacatgtctatgataaagtttaatataaattaggcacagtaagaaattaatgacaacaataataaaaatggaacaattacaacaatatcccagcatcactactcttatgctttggggcttttaataagtacaatacaggttccgtgaacacaagcacgcagtcccttggcagtcgatctaataaacaaactcgctgccaagtgactaatgggcagggagtgtggacagtgcagacacactggacaaagggaggattcacatcccaggcaggacagagcaggatttcatcacactcagagagcatgcaatttaaaattgatgaattgtttatttctggagttctccattgaatatcttctgacttccaattgactttgggtaactggaaccatgaaagcaaaattgtgcataaggagtattactgtgtttggtctttccatgttaaattaagtatttagatcaaacatagggattggaaatgtgaattctggagccaggcagcctgggttcaagtcccagctccaccagtggcaagctagaaatccttgtgtaagctgctgggactgtctgtgcctcagttttctcacctgtaaaataaggatagtaattgtatcttcttcagagagttgttgtaaggattaaatgccttaatccatgaaaacacatgtgacaatgcctggcatatggtaagtgctcaacatgggtcagcttctgtatggtctacacattaatgcatttggctcagaagcagtctcctagagtcctcttcctaggtgctaagagccttccattgtgtgtgaggctttctctgtgttgaaatgtgtgtttaaaataaggacttgggccgggcgcggtggctcacgcctgtaatcccagcactttgggaggccgaggtgggcggatcacgaggtcaagagatcgagaccatcctgactaacacggtgaaaccccgtctctattaaaaatacaaaaaattagccgggcgtggtggcgggcgcctgtagtcccagctactcgggagtctgaggcaggagaatggcgtgaacccaggaggcggagcttgcagtgagccgagatcgcgccactgcactccagggtgacagagcgagactccgtctgaaaaaaaataaaaaataaaattaaataaaataaggacttgacaagagctgctcactgcccaggagaggtggaacctggcgcagtaagccctggggttggacagcatctctgttcacccagctcagtgggggtggcccctgcctcaattcctggtgggctgcattgtctcacacatggtggaggccctggggagaggaagggacatagccaaggagacctggagcctgtggcggcctaagcctccagcagaggccagaaggcaacaggctttgatgtgctgccaggctaagaatggggcaaaatgccaaggaacagagtgattggcacctcaggcctgctgtctctgaattatcatctgcttctagagttgcaaaggcaggtgttgtcctgagagacaggcagggacagatgccacacatgcaggagcatggcagacggattcaagctgtgaccctccagagaccacagtgatggctgggtcctccatgcccccttggatctcaaaccaccgggcaggtgactgtcagccttcctgcacctttaccacccccgtagttacgggtctgtgggcagcttctcccgagcagttctccgagtggccagcagatggcggaatttctcttgtgttccagacagaggctttcaattggcgtagcatttccactgctgagaaccagggagaattaagtactggtaacattttgaaaataaaatgtagcaggcaaaataccttggagaccacaaattgggagagccttttaatttttttaatttttcagaaaaaagatgaaatatacattagaatttacaaaacacttttatattcatcatctcaccgtaaaaagggaaaagatgaaaatcagttttaacccccttttggaaaacaggtaggctgcagctgagtcttccatctgcatgattgttagactgtaaattggatcactcggtgctagtatgtgacaatattattattgctgtaatgatattgataatgagaatatcagaaataatagctgctatttattaaatgccactatgggctaagcattttacatgcattatcttgtttaatccatagaataacaacacgatgcagggatacacagtgatttactgttgaatcttgagactatagcagcagcctcgtgcttattgtcccagaagtaactcagcatcaccagacaaaagccaccaagagttaactcacagcgggattcgtcctctcaaataaaaacatgccaacctgtcccttttgcttagaatttaattctgctactattttcctctgtcctgcttagcagaacatactacatattacattaataataacagcaacaataataacaactatcatttattcaatgcctagtatgtgccaggtgctattctaagaaaatcttaaaacctcacagcagcattactgggtaggaacttttaatcaccactttactgatgagggaaataaagcccagagaggtctggcagtacttctaaagtcacacagctagcaaacagcagttaactccaggggtgggaatctgtcactaagttaatggccctcgtgtcttaattgtctgaatgaatttcctactgtatattccttggtttcatcccagcgtcatcattagtctgacgttctgcttgtaagagcattttcttgatgttccattctttgcctccatgggattttttttttttatggtgagttttgcctctgagcttgtgtccatgctaattccaaaccaaaaatacagtcccagttggtgagtccagattggtggtagggacacactccatatcccaagataaccctgtatttctaaattattggagggatttgactgtttggcagagcaaatgggcatgcaagatgttcatctcagcagagttattttacgtcttttttgagtgtgtctcttttctctggctcagaagaaagggcactgtaggatgactataactaacagtaatttattatatattttagatagctagaagagaggcttttgaatatccccaacagaaagaaatgattgatgtttgagttgatgtatgtgaattatcttgatttgacctctatacatcgtacatattgtaacttcatgttataccccataagtatgtacaattattatttatcaattaaaaataaaataaaaagaagcaaagggcactttgcttccttcctcagcaggtgtctcatggccagcactggccggagtgtcacagttctgaagccttaacttagatctctctctgttgttctctccccctctcccctctctcctttgtccctactccactttccttcctctcttgtgtgctctatttccagacacacttttgggtaccccatttggatgagaaaatacaggttaggtgtacatatcagcttcctgtgtgctgtcaaactttctttataacatttggattttggaagtgcctcatgggtgtataggatggatttttgccagaagggcttattttcaggcctcgtgaatacctctatcaggtgaagacagctgtctcttaacaactcaagtaatagtgcctgaggcctggttagaaatcctgttgcctctgcaaatgggactgtggctggtatctgggttccccgttctcagccttcacatcccagttcccaaaagtctcaattcccaaggctcaggtggaccacttccttcctttctgctgccagagaaagacatcctgttttaggggctaccctccaagtcaggagctgccatcagtactcagagggtagtaccagctgcagaatgcatttcagagctcagggagccttgaggcaggacaggctggaggtttcctgcagtcagtttaccgggagaacgttttcagagtggggtctgtggaatgttattggctaccacatgtacataggcatacgtgcgctctctctccctctttttctttctctttttttctctctctctctctcactctgtcacacacacacacacacacacacacacacacacagtcacactgctacaaccaggatacaaaatggttccctggctgagcaagccccgggaacattggattaaactgttttctctcaaaggtcttaattctaaaaaagggtcacagcttggagggttttctacatttttttaggccaaggagtctcttctggcagaccatgtcatggggctggtcatctgtggaacacacttttggaaactccacacttgagatatagttgtaagtgctagttcttgtctaaaggcagaaaagtacctctttgccaaacacccagctcagcccttgaggagggaggcaacgggatgtagctgtgctgtgtgccactcccttggaatgagcaatgcccaggcaagaccaggcctctgtgtcaacaacccattactctcttttgtgcacacttctcagtgtgggcttcagtccccaccctccatgtttttcctaggggtccacaagttcactctgtgagtcattgtcacttaacctcagggtagcttttggggctggccttatcttctgagagttcccattttggcagatcttctgagctcttccaccagcatcatggtctccatgtatgcctggatgcagctcttctaatgagactgatccccaaagcttggaaacctccatggtactagtctggcactgccagcaccataccatggtgttcctcccagagcagggcagtactgacactcaggacattactgggattgaatatcagacaccatgacttcctttgtatggccctgcccatgcctctctgtcctcaggccacttcaggccctgcggaccagatacttcttgcctccctgcaaatctttcatgaaaaaaacagccccgctataacagggctacaaaaggcaaaggtagcagtctagtttggggtcttcttagaagcagtaggtttggggattgggttgggggaggcctctaacatcttagcccagcatcttgggacagtggatgttactacctcatgactgttgttaacctgacctttcctacatctgccctaatacagaaactaggactctgtatctcatctctgtcatcctacagtgaggtgaatgcagagatcctgcactgatgtgaagcccatctgggatctctagacacaaggccaccggcatgagcatggcagcccagggagaatacagatggtgtacctctatgccaaacggatcagaatgcttcatacatgtagcacagattaaaggctccaatgacaccttgagtcaggattttaggaaatgaacagagattctaagtctctcaaaagccactccagacataaaaacaaaatacaataaattatcctagactggaacctttactaaagggaaaatattggccaaagggcatcatcctaacaattgccaaagttagagaatgcactgtaggttacataaaaatggtacctcaaaggtaaatttcctgaatgtgataaatgcactgtggtaacgtaagagaacatctttattcttaggaggcataccctgaaatattaagaggttaagggacataaaatatgcaacctactctcagtagttcataaaaaatactaataaatatctacaagataaattctttaaaattcattaatctgggtgaagaatacattatttttgtatttatttgtcacatttttctgtaagtttgaaaatatctcaaatattatccaagggggtagttgtttagagatgaatttcatctctgtgatgtaaaacatgcaaaaatatatcccaaaaccaagacctgcagaaactgagttggatatttgccctggtctccttagcccaggggtcccagtgctccatgaggccactacccggagctagatgaaaagccaggcctcctgaactggtccttgatgggggatcttagccttttctccctttagaggagttgatggccagatgtggggaattctggctgaaagtagaggcataaatgcaaagatagcacaacactattttggtgaaagttgggaagtctttttgcttcacctaacaaggtctgcatgtttttatgaatgctaaccttattacaaggtatatgaactccaacctggcattcatagatccccagagcccatgataatgactcaaaggcatgctacaaagtaaatgatcaaattctatgatcatttgttgccccataattagaaactggccatccaggtatttcccccaatggtgcctctgacctgcacccagacagacctatgacctgtgagctgctgtccccacttgcctcccccatcacccagctctcccagcacttagtgcccaaccactgggtggaaacttccagtcttcaggatccaccttgacaactccaacaagtctgcttctgtgtgttcctcaggctgtcagcagcaggggtgacagagtataggggggcaccatgaagtggtgaaaagagcctctcctccatagcctgtcacattttgtcgctcagacctcaaggccaccctgttcacacccggagtctccccatttatcctaggaactgcgattctgctttgagctgaaatgttgccaagcctcacatgtaaaaaaataaataaatacacaaataaatcaaaatgaaacagaaaaaagacacaaggattctgtctgcctgtcacccctatgactgtacagtctcaaactcagtgcatgatgcctgctgagagacaaacctaacactttctgcttcatcccctagtacttcccccaacccagatttttctttgtcgctgtatatgaaacaaaaacctgctctgcatattagtggatttaaacagctctcaggagatgatggtagagtagaaatattaccagaagttgtagctgttccaaccaagtgagcaccttttttgtgtctggctcagtgctgagtgctttatgtgatttatctcattcagtacttctaatcattaagttctatgtcatccccatctctcagatgaagaaaccaggaagttaactgatgtgttcaagatctcacagttagcaagaagtggaacctgaacaattgtctggacacatctgactccaaagtccatattcttcacccactgtatgattttgctcccctccctgtaaactatggaactgatgtggggctgggtgttttcttctagcgtttggactctagcaaaggctgccctgcccaaaatgacctgttccccagaatttctacagggagaggctataatacctttatgagtcatatttacctacactaatgactgttaacaatattaaagctgaaactttaaaaacgagtcaacttgcaataatctaatggaagccagaacatacctaactcattcccattttagatttgactttgggatacattgagtattttgaaaatgacagactcctctattttcttggctccgggtgattagactgagtttgccttctgtgggttcccctgagtcaaaggaaagagaggtagctcagaagcatattgcatcaccaagaaaagttggtctgagagtgaacatctataacagaaagcccagaatgtgaattattcaaaattagacaatatagattgcacatgcttcttgttaaatagatttcaggtgaggaacttgttgcttctctgtgcagttgagttcctcatccatgcccaaaaatataggtagaatttatgttctgacagatgcttatttatcccgttttgtacccataatctacacttgtcttaatttcctctcaattatgctcaggcattaactaataatgactaactacaaccccagataattattgctatctgttccctttgtaaatataactccagcacagagctagaagaataatggcatatttacagaaggcagctaattaaactgagttccaattgctttcactttgccagaaggagccattttcacagcaaaaattgggtggatgcttgcatgcttaccaggaacaacctgaggtaacataattcagggttcccgaggcaaaaattcagtgcaagacaaatatacacaagcaataaaaatctcattaaggaagatatgaagattgttttaccatagtccaaccattaaaagggggtatcattttggtgggtttatttaaggaatagtatatatttcattgtttcataatggaagtaattgcaaaggactcttagacaatccttgaagaacatttttgtcttctgtttgaatctttcttttctagtttatgaaactacttcaccatctttagcctcatcatttctaaactttctaacagatctgagcattgttaagcccaatacccaaaattgtgaaagtccaaacacccaccctcaccccttctcctccatctgctcctcatttatttcaggaatttggtcttaagcacaacatgatctttcatatagagtatggatgcttctgtggtgtgatttctggagtttaactgaactcattagcaacagtcacacgaatgcaagttcctctgacaaacttggattggaaagcatgtcttcagttttctttctcttctgggtttataggttattcaaacccaaaccaaacaaacaccttcctgaaataacaacagaaaaggaacccgacaccttgcattgtaaagatgccagatgttgtcttgtattagtctgttttcacgctgctgttaaagacatatctgagactaggtaatttataaagataaagagggttaatgaactcacagttccatgtgggtggggaggcctcaaaatcatggtggaaggctaaaggcatgtcttacatggcggcaggcaagagagaatgagagccaagtgaaagggaaaaccccttataaaatcatcagatctcctgagacttattcactaccatgagaatagtatgggggaaccgcccccatgattcaattatctcccactgggtccctcccaaaacacgtgggaattacaggagctacagtgcaagatgagatttgggtggggacacagccaaaccatatctcatctctaaaggaagaatgtgtcttccttgtcctagctttaggagagaaactcaggaacgttttagtgcatacttacctggattatttaaacaatattttcagttgcaatgctttgctgtgtttctggatgctgtgctgagttttcttcctgcctgtgtgcaatttctgaattcatttctatctactggaagtagtgatttggcaggcatcagcactttttccatgtttaattaattcctctaattttgtggtaaatgagaataatgggacttaattttgctatttatgtaaaattgattggtaattatggggagcacaggagatttggctttacaaacaaaaattaagtgacctctccatcatggttccttggcatgcctcattcactcatcagggaaaagcagaaatggcagcagagcagatgctggagggagacgagggcaggttttgacttttgcagaagttggaatatggaaatgtgcagggtcttgttgaaaagtccaaatgaactcaagccagaatcattcagaagataagatgtataggacagaaacctgtttaactgtttttattatgtcatatttggcatgatttgatcacctaatttcaatatattcctatcttttgtgttctgaccaaaccagggatggttggcaggaataaggtctcttcctagaggtgctttatgttaaaggaagttctcataagatgtggtctcaagacagaaggtttttacaattattaatttctctcttgaaactggatgtagctccagatctctgattcttggtaaatgatacttacattgtaaaaactagtttgttataggttgatatctagacttaaatgatgtctacatgtctatgtctgtatctgtctctataagtgcctctctacacacacacacacacacacacacacacacacacacagaaattttgctttcaactcaaggagtcttggataagaagacaacatacatgaaaattattatcatccctaagtattaagatttagttattaccatgatggaatttatttttaaagaaatgtaggccaggtacggtggctcacgcctgtaatcccagcactttgggaggccgaggtgggtggatcacgaggtcaggagttcaagactagcctgaccaacatggtgaaaccccatctctactaaaaatacaaaaattagccaggcatggtggcgcatgactgtaatcccagctactcaggaggctgaggcaggagaatcacttgaacccaggaggtggagattgcattgagctgagatcgtgccactgcactctagcctgggtgacagagcgagactctgactcaaacaaaaaaaagtggccgagctcagcggctcaagcctgtaatcccagcactttagaaggctgaggtgggtggatcacctgaggtcaggagttcgagaccagcctggctaacatggtgaaagcctgtctctactaaaagtaataaaaaaaaaaaattagctgggtgtggtggcaagcatctgtagttccagctacttgggaggctgaggcaggagaatcgcttgaacctgggaggcgtaggttgcagtgagctgagattgcaccattgcactccagcctgggtgacaagagcaaaactctgtctcccaaaaaataaatgaaaattattttgaatgattttgttttccttctttttggcaccatcaaaattcagttccttgatgggcaacattcaatcttctggctagatgacaagcagttctggtagggttgtcataaagaaaaagaggccggaggttgcagtgagctgagatcataccactgcactgcagcctgggctacagagctggagtgagactccatctcaaaaaaaagaaaaagaaaaagagacaaatcatgccccattactgtgccagtagcatagcatagacattctcaggtgaaatcaaagagacattacatcctggaagctgatgtccaacttcaaagacttgataaaatgaattcttgtgatttagccacacagagctatggaaaattatggacaatatctcaattagttgatacttattacctacatattataactgtttatttgaggagcctggacagtaatagctgaaattttcaaaactattacttagaaataataagaaattattactttgaaataagatgtgtttatctcagtaccacccttcatggggatcagattttaccttataatggaatagacaggaatatctggcagtattaatattcattttccgccaagatatttttttcttcaataaagtaattcacttgatctgtgctttgtaaatcaatgcagagtttcagaaagattcacatttaagaaagcttttgccttggctaaaacaagagcagagtgcccagaacataaacactagcaacaggttctgccctgggttggtaatttcccgcctgtgacccatttggaatcagatcatcagggatcagactcagcattctacgtgccttacaacattccatccattgaggtttaaggtggaaaatagagttgagacaacaaagaggcctaggggatcaattgcaaatatcactgcataatgaataatatttccctaatttttttttgtattgattctacacctatggtctcccaaaacagttctgataactttaaaactcagaggctcatactgccttcctggaaaagagattcaaagtacccaggcaaaaacccaaattcattctttcagatttatttttctttcaaaaacctactttctggtaaatcaaatcagataatcatttctgcttgttaaaactattaaatcaggaggtttggggatagtagcaacagtggcagcaaaatgtttgcgtcttcctgaatcttcacatagaatcagactgaaagactactcagcaaaaccaaagctcatggtttccgaacaaagcaaggtgacagggtatacctcaaacctcaaaatgcaacccagtatcagcatttgtctaacagaaaacagaggaaagcaatgggcatctgacagaccaaagaacaggagaacccaaaagagccaacagacactagctggaatgcacagcaggcggatttcaaagtggcagcaaaaacggggaggggttttgctgcatcccataacagatgagtgcctgtcaggtcttaaggagctggggcagtcttatctgcatgaactctccactctgacttcccagggtccctccaggacaggactctgcaccaacgagaaactgttgggagttgaatcaaaatttagcagtacagggacaatagatacaacagaaaaacaagatctggataaaaataggagagaggaacagatacaaagaatctcaaaaacaggccaccgtatttttaatactacgtgaaaacaactgaaaagagagttctattaagtaaaagaaatcttctctgaaccaagctttcttctaaaagttcaaggagagtaattttacatagatatgagcgaaagaaaagtatccaggtcaaatcccatacaaaattattataacaaagaaagagaataaatggtagaagatatccttatacaggatgaaaacattccagagatagatactcaaaaaacaaagataaaaaattgggacattctgtttttttttaaaaaaaagtctaaaatatgttgagaaaatgatataagatatgaaaaaaacaaatcaaaattaaaaatattcaaattaggtgacaaagctcaaggaattaaaataaaaataaaaagtcatttaaaaaatagtggctaaactagaaggaacaaaggagtaaataaacacaatataatgccttaagaaaaatggaagataaaaggagggaattttttaaaatcaaaaagaaatgaagagataaaaaggattcacattaaattgacaaatattgaagaggcaaagaagatccagtatatagataatgggagtttgtgagaaagaaaactgaagcaaggaagaagaacaaatctaaaaatataattaagaattttatcctggagttaaaaatttttaaagtgcatattgtgaaagacattttttcaatatcaaccaatagcgagatatagcccaataaaatgtctgaactttttttaaaaatggaaaataacatttgagcatcctaacaaagagaacccttgacttacaagggaaagaatatcagatgtcatcagactatttgacagcaacattttacttcagaagaaaatggaattaagaaggcataaggaaagtcatcatccaccacaattgaccttctagtgtaaagggcatagacagtcatcagtatccaaattggaaagaaaagtcacattagccttgtttgcagatgacatggtcttatacctagaaaaaactaaagactccaccaaaaaaacctgttagtactgaaaaacaaattcaataaagttgcaggatacaaaatcaacttacaaaaatcagtaacatttatatataacaatatcaaacagtctgaaaataaaaagaaatctcatttacaatagctacaaaaatatataaaataactaggaatcaagctactcaaggaagtgaaagacctacaaaaggaaaagtacaaagctctggtgaaagaaattcaagaggacacaaaaaagtggaatgatatttcatgctcatggattgaaaaaagtaatattattaaaataaggatactaccaaaagcaatttacatattcactgcaatccctattgaaatattaatgacattcttcacagacatagggaaaaaaatcctaaaatttatatggaaccacaaaagactctgaagagccaaggcaatcctgagcaaaaagagcaaagctgtaggcatcatactacctgacatcaaatttactataaagctatagtaaccaaaacagcatggcactgatgtaaaaagagacacatagaccagtgcaacagaatagagaacctatatataaatccacacattcacagccaactcatctttgacaaaggcaccagaaacatataatggagaaagggcagtcttttcaataaataggggtagaaaaactggataactattatacagaaggaaactatatattgtaaatgaaaatctaatcaatagattaaaagacttaaatctaaggcctgaaactatgaaagtactagaagtaaacattggagatatattccaggacactggtctgggcaaaggttttttgtgtaagacctcaaaagcacggcaaccaaagaaaaaataagtgggattacctcaagctgaaacacttctgcacagcaaaggaaacaatcaacgaagaaaagagacaacctgcagaatgggagctagtatttgcaaactatgcatccaacagggattaatgaccagaggagttcaaacaactcagtagcaaaaggaacagtctaacttaaaaatgagaaaaagatatgaacagacatttatcaaaagaatacatataaatggccaacaagcatgtgaaaaaatgttcatcgctagttgtcaaagaaatgcaaatcaaaaccacaatgagatctcatctcaccccagttaaaatgacttgtgtcaagaagacagacaataacagatgctggtgaggatgtggagaaaggggaaccctcatatacctttggtgggagtgtaaaacagttaagtacagccattgtagagaacagagtggaggttcctcaaaaaaccaaacaaagagctaccgtatgttccagcaattctactactggagaaaaagaaaaaaaaaatatatatatatatatatttgtgtgtatatatgtgtgtacacacacacacacacacatatatatatatatacttttttttttttttttgagacagcgtcttgctctttagctcaggctggagtgaagtggtgccatcttggctcactgcaacttctgtccccctgggttcaagcaattctcctgcctcaacttcccaagtagctgcctcagcctcccatgtaacaggccagacgtgatggctcatacctataatgccagtgctactgggaggccgagttcaggtggatagcttgagctcaggaatttgagacaagcctgaaccactgcactccagcctgggcaatagagcgagattctgtctctagaaatcaaaaacaaaaaaaggtagcagtggtaaatgttatgtgtgtattttaccacaatttaaaaaattaagaaaaaggaaaaaaataaatagaaatgtaagatttcaggggttacctttcccattctctctctcttttttttttttgtcaaggaatctagtagagaattgtcttcagattaccaaaatgactagagacctcaatgttagaactggcagtaggcactaaatgtattgtggcagtacttgtgtgtctatgactaagaagagaaagattctggtaagtaatgcttgtatgatttgagaatgcagacatagtaccacaataaaatgaggagaaagatgggagagcatatgtaaaaaatgttctatagtcaggaatcattattgatggctttagtgttgttattccaagactcatgtatgtatacaagtgtaatgtaggaaaattaaagtaaatttcttaagctcccaaatttgaattaaaaatatcattatgaattcatgatatatttagacgttgagcattgatgacttctacattcaaaaaaaagcgaaaaacaagacatgatgcgtctccaggtgaaacaacccagtaccaccattagtcttgccaaaagcatcaaacttgaatgtaattaagcctcttgatccagttgttagtttgcaagaaataccaaagagagaggctcatgttgaattgtctgtgtgtgcaaccagtaaaatccagactgcaggaaactctacatgtatggcacaggttcttcaacaaatacatagtaaggggaaaacatggttggagggaaaaatatctcaactagaataccttcttcaccttgcatttatattggaagaataatagaagaatttaagaattgccttaaaactcctgaaatttcttaaacaattggttgtatgataagaaaatgtagggaagatttgaggattcaactcatggccatgatagcaatagctattatgcatggaaagcctaccatgtatctggtactgtaataagaaccttcaatgtattagctctaatctttatagcaatatagcaattctgtgaaatagtaaatataatccccattttacagttgagaaaatagaagcactgacaggttaagaaaatttcacaagataattaatacatagctgagtcaatgggctaacccaggccggtggacttcatagctcataatttttaactacattgtataaaaaattaacttgaaaatgtgtattaagaagcctatgttgtaaccttaatgctatcatttgggaacttaaaaaggttgtgttaataaatcttttgttacagttcagacataaagctaaaaaggatggtgtgggatttagcattagccaaatggtattggcatctaatcatcagcgtatcagagagaatttatattggacattaatttttggctctgtagagatgtcatatttttgaactcttattctatgctttgagaattgtcaagcactgcttctaaacattttatcactttcagtcttattttgcatctctcattttatggaaattttgtttagcaacatacttaaaatcttggtttctgatagaatcagaacaagattttgatgatgcccctgaaggcaaagtgagaaatcattaaactgttattagtattctataactgatcccttataccatggagctaagcttcttgaagaaaataacttctgagatgctgacccagtgtaactgtgttctcagcttagcacagcccagatatttcaagcatggtaaacagggagctgtctccaaaatggcactgattttagggaatttctcagtttgattgggcagcacatacattacaatccatttcacttcatgatatctttattcagatgccaccatgggaggtagcatgatcttagagtagcatggaccaccccagagatttctggaggggattgcaataataatatttcaatttgctataaggccaagagtttcatgcagaacctttctctttctttctacttcttttcctgtctgactcattctcactcagcttaaagcccatcttgaaatggtgttaaatctaataccactctcagatttcatcaatctttgaagttggccagggctacgtagagtacaaaggcaagcaaaaatgggccactataaattagagattggaaaatacctattagaacaccaagattctgacaaaactttcccctccaatatacagggcttgaaattgaactggttttctccttggacatgcctcaaagaattctaacacctcctttgtagtggattgtaattccttgtgcatcccttgctcacattacctccaattctttattcctgatttttaaatggaggtgataacttttgctgcattacaaatttaccaggattccacaatctgcatgttggtgatttagtccctgttctggagattttaggatgctaacaaattgacgtaaataagcttggacccctgccaaggaatatagcgagccactgagcagcttttcacatggaaggtcagtgcatttttaacaaaatacagaaaaaagatgagccttgggtatgttttagatccaggaaagatgaggccagggaaaaccgtcttccctcccttagaagactttgtggaagagggggatttttaggaattgcttaaatgatggatgagctaccacctgtttcacaaggattctgtgttgctgaataaaatactttcaaatcactcaggtattactggaagagatactatacaaatacacagccagatctgtgttcgaagtggccctttaactttggccagccacttattctttaaataatctaatctcctcttctgaaagttgatttgtgtatatttgtacttttatatgtggagtatctaattgtggttaatatgggcaataattttaagaatgatgtaaaacaagatccatagcatcactgaaaaatgtgacggatttgcacagtgaagtgtctttgggattgattaagactgttttgcatgacttggtaaaggtaaaatgtcatctctcttttcttcagacaaatagatttggttatctttttttttttttttttttttttttttgagatggagtctcactgtatcacccagactggagtgcagtggcacaatctgaactcactgcaacctccacctcccagtttcaagcaattctgcctcagcctcctgagtagccaggatcgtaggcatgtgccaccacgctccactaatttttgtatttttagaagagacatggacctactcttagcacctactcttaggaccaaattaggaccataacaaaaaaatttattgaaaatgatcatattctcttttactataaactttcagactataatttcttatagtggtctggtcttcctaattatgtttgaaatcctgacttttatttctttttcaattcttaggggaaactaatttaattagtaagttatcaaaatcttttgatctttagtaagtactcgttatgttggtactttataagctaaaaataagaaaaacaacaggaacccctgaaagattcaatgaaactttctaattctagacctaacgtttgttgagtgacttgaataagtcacttaacatctctatggttcaccttcccttatgcccaaaatctaacaaatctctctcctcttattaccccaaatgccaatggatggataaatgaataggtgggtgcaagggtgatacatggatggatgcacggttggatatgtggacagatgcatatttgggtgtgtggactgatgcatgtttgggtgcatggaaggctggatgggtaagtgcattgatggggtgcagggttgggtgcatggatggattcatggattgaaacctggtttaaaggaaaggtggaaggacatacaaaagaaagtgtttttattaaaaaatgaaattaattcaacagaagaatgaactgaaataaagctggaaaaactgataaaattcacagaaatgtttctttacccctgaaaggaactactgtgcctaaaatactttttaaaatttttcagaaaatgtgtttgtgccaagctccatgttggataatatctcagatgttttctttggtaagaggcctctatgttttatatggcagaaactttatagcaagagtcgtccatttgtataataagatgattgcaatccatagagacaacctcctgctatttatcttacggtccagtctagttcgtcgctgggtctgtaaggagaggtactgaacatcagtttgaaaggttcctcagagcatccagagccccctggtataggtaaagctaagcaggggagccattgttgtgttactttgttttgttagattaatgattcttctgttaatatttaaccttttgtcaaattgtgatgcataaggttgtacatctagatcaatacaaatgaataatgagacaggcatatttttttcatctcatttattttcctgctagtacacaacagtgttttattgacagtgtgtttcacatggtccattattaattaaacttagagaaggacatatcctttgccacatgaaaagaaacaccaatgtttccctgctttgatctttcctgaggacttggaatagtaaagaagtctcttaggactgtggatggaggggagagtgaggtatgcttcatggagtgtttgaagattgggcactatgtaatatgccctgaggggcagctctgaaaggttctgtgtgtttttatggttaggatgttattggcaatgatgctaaataagaaatgcaacagtagctgggaatttcttcaaatggcatggttttaaattactagatctcccagaatagaaaagaataataaagtacagatttcctcaatccctcacaatatcattttgccagttttatattttaaaagcatcctcatttatgcattctctcaataaaatctgtcagggcaaagtcctcactccatacaatgtagtagtaagagcagaagcttcaccatcatgtaggggttctgcggagacattcttctttcaaatccacatttctcaccagggctctgaactccctgctttgtatttgtctgtctgtgtgtctctctgtctagctcctttgcttctctcctgaacatctgctctctctcctccctctctgtcatctggacccctcatcctctgtccaaatgatgcaaggatgctctactctctccaagttcacatgccacttccagccacttatagggactgatgagcaaattttgattccaagttcacggaagaaagaagctgttcggccctgcttgggccagatggtccaacgttgctgtacgtcacccatctccatgggtgtggaaggaggggtgattgtgggaggagggaaataatcatgacctaggcagaccctccaagatgtgtctactacaataaggtacctcataaaggtgtgctgaatggaaagaaagacaaggaattggaataaataatgtctatttaattgtaaattgtactttcttcttgagggcgtgtaaatttaagaaacagaataattataacagcattttcataaattaagtagtattaggcttaacccgagtcacggctgggtgcccaacacagcaggggtttaataaaggcttgttaactgtctagaactctgttgaatttaatttagcttgatttagcatttcccatatgcaaagtgcttgacaacaattgcatttcctgatatttgcagtcttcctgagaacctgaaatgctatttctcattttataaatgtgaagctataattgcccagtgagactcatttctttgtgggaggagggtggaaataatggttaaggacaccaaattagatccagatcttggcttatctgctcactagttttgtgacgttggtcaagttacataatccccttgagcttcactttcatctcttaaactgatatgatagaagttaccaggccaaggtttcatgagaattaattgagagcttagaacgcagaaggtgctcagtatgttagctcttaataattgcaatagttattgttgtataagattttactgcatgttaggcaacaatttcttaaagaagagtcccaggaatgctgtaacataaatggcttaagagtgcatgctgttgtttgcctgatagctccctgtaactgatacgctcaggttacaggcttaagtatatgtgttttattctctgcatcacacacagagttcacccctcctcttgggtgttggtctgttggatccgcctcttcaagagacagaccgagctctgaaatattgacttgaagggctgcgtaaattattaccttgctgctcttacctaaagaagagagagcaaagctaaggggcaggtgatgtggtttggctgtgtccccacccaaatctcatcttgttgctcccataattcccatgtgttgtgggacggacccagtgggagatgattgaatcatgttggggggagccgtctttcccatgctgttctcatgatagtgaatggatctcacaagatctgatggttttaaaaacgggaatttccctgcacaagctctctatttgcctgctgccaaccatgtaagatgtgacttgctcctcctcgtcttccaccatgattgtgaagcctccccagccatgtggaaccataagtctaataaacctctttcctttgtaaattgtgcaggctcaggtatgtctttatcagcaggctgaaaatggactaatacagcaggtatggagaagccatgcacatgtccaagcagagcataggatcattgtgtgagcacaggaacaggttcaaaacaaggctgagcaaggagagagggctcaggccttagttaaaaaatggcactggggacctggaggaagctgccaggggaagggctaggggtttggtggggagaggagctagagttcaaggcatcatgctggggctgaagccattattatgcaaatgtgatactggtcttaacagtgatcagaaagcatttatatgctaattattataatcatatgctaattattataatattggttatgtgttgactggctttcttcctgctaattggaagaactcaaagttgtcctagtaatgtggctcatggtactgtcttcagagcagctaagtttaatcagaccatagcatcagtgttggtacattcatgtaccattttatataaggtgcaatccttatgatttcattattaatcatggctgcagcgctgtcttgaaatcatctgaataccagttagccacttgttgattacttcagttattccaactttgttgagcaggctccagtgaaacccagattacctagaccctacagtctagaggtagaaatagctacatgcaccatatatgcacatgatgaatgttttatgcagcttaaacttgcttctcacagatttgggaagcgaaaagtgtagtgcaaaaaatacaagacatttggcagatacacccatgtctcttttatctatgctgtcaggctaaaaactcttgactgagctgtagagggtcaacagatggccaaagcatcaaccagagaagcaagttcagcctgaatccaactcattaggattctaggtcaggcttcaggcaggaagcctgaactcacaggccagtggaaatagacaggtgttgacacaagtgaccttcaacatcaagacctgattgctcctgccattgagactggcaatgtggaaggaaagggcaatgatataccttcaagctgggattataaaagcagcctatggttgcagtctcaagttggaaggaaacaaatgtgttctacaagggtctggcattcacaggaaattgctatcttgggagagagttgccaagctaagactctcaaatctggcagggtttgcatagttaagtcctagatgagagttcatggtcaaacgttttctttacagtgtaaagccatttttttaagggaattagcagcactgaacagtgcccttgtgatttcctgtgctgggggaaatgacaattgaagcaaaacattgccattctacaaattctatatttattcatccaatcagtcagtatcttgcaggcacctaccatgtaagggaccactaaaaagctctgaattacagcagcgcaaggtagagttgatgctcttcttcaagaaaaggagaaataatgggctagcaagaacatagcagaagagatgtattcaccgtgtaccctgctcccaggcatgagagagcaccagcatgtgtggtgtctgatgagggcctgcttcctggttctcatgtgtctccaggggtgcaagggcaagagcagcctcaggtgtactttataagggcacaaactgcattgatgagggctcttccctcatgtcctaatcactttttttttttttttcctgagacggagtttcactctgtcgcccaggctggagtgcagtggcgcaatttctgcaacctctgcctcccaggttcaagcgattctcctgcctcagcctcccaagtagctgggattacaggtgggggccaccacacctggctgtgtatgtgtgtgtatttttagtagagacggggtttcaccacgttggcccggctggtcttgaactcctgacttcaggtgatccgcccacctctgcctcccaaagtgctgggattgcaggcacgagccactgcgtccaggcccctaatcacttctgaaagacccaattccaaataccatcacattgggaattaggtttcaacatatgaattttccagggacacaaacattcagtctaaagcagctccttgagccatgagcaatgcactttattcctcaggctgtcgcttcaccttcagccctcaggtttttgcaatcctgtctacatggcctctcactttgatttccttagccatttctggtaggctactgggaaggagttaaaacggctctaggtcagccttccaccttcagccccacataatccacatcttattcctagtaaagtctcatgcttttgttacctggacatattctggaaatggagaccaatccccagctgccatctctatttaactcccacctactcaattgctcaagcaattgtcagatcctagtctatcgggtccttggctgtggaaaatatgcaccaggttctcctttaacgtgctgctgggcccaagccttagtccttctccgtggaaggtgggtgaggacttgtagcacgccaacagctctctccaaaaataccctctcccaattttctaaccacccagtccttttatagcctcattggaggcaagggatttaaaagtcgggaaaccacgttctagacaagttctttgaaaattttgcttatggtacctcctttggaatctggtctgtcttgaatcttggtgcctcaactaaaacttccaatgtaacattctgctacgtagatttggtaacacactgctgggcgtttgggagaaccaggcagaagagaaaagaatgtcctctgtactccttgataatgaaaaatggatattggtggagagacagggcagaggggaattccctggcagaatttgggacgagtctaaaggaggaagagaaatgaaacagagaagggagaaatcaagaaaaatgtagactttcaatggaacatctgagaaacacttgttgagaagatgggtcactgctccggtttgaagtcataattgttcaaggaaatatgcccagttagagtctttgtctccatcccagggctgctattttggtttcagggaagcagctcagtgattcctgagaacatacagtttacgaaagagctgttaggtttgtgagaacacaattgaactgtggattccttagtggtcagaccgatcattagttccctccatcccgaaatggctctatttgtcttacattataaaccagctcattgaagaacagaaggcttatgccaggcctaataatcaactctgccactggaaagcactgtcgtttggcttctggatttttagttttttccctctacaggcttaaaatttgggggcctgtcttgggaaaccatgcaggtgaagctcagtcatttgtgtctgaaatgagatgtctattgggataattgcaatctggtcccagaacagaccatgaacactccccagtctcacccagggcagtgatgaggagttatgtgtacctgtggttcctagaccagaaagcatagcggatgcccacactgtaactctccagattggggctgctgaataaattttatgagtgtcaagatttcagtggtgaaaagtttggcattctcatttaccaatttcaattatcccattaagaaaacagtggctaatgtggatgaaaaatgaaaggccaattttaatccacctcccaaagctttctcattgattgggacattctaactgtcttttactcaaggcctgctccttagcgccactgttttagctccctacatgttttcttcctcacatagtgaatacatttggggtatttttccaagtcaccagtccccaactttaactgacctcactatcaaaatgtaacccatccccttccacaggagccattctataaagtgtgaacccacgccccagcctcaatcacattagaccaagtttgagtgacatcctacaagctggaccaatcagaattccttccttctaaatttggaattgagatcaacaggtaatcagggagattatctccatttgtctggacatgtaatggctatacttaggaaccctggtgaagcctagaacaaagtgaggcaacctacagggagagcagaaaatgatgtggattcataaagaaagagagacaagggagagggagagagtgctgagttcttggcaacatccagtgcccagttgcaacctttcctgaggcctggctgcattcttggtcttcgtttccatgtggaatgacagcatgaactggtttgtccagtttaatgataatggtgctccccctttcaccaatttaaagtccacagacaccctatttctatgggacttcaattttagtcatgtaagagaaactctctttagcctaagttatctcaagttaggttttctgtcttgcatgaggaccaatgcctattgcagccttaacaaacagacattttagagagttatctccattttgcagatgagaaaactgaggctctgggggctaggcaagttatccaaggtcaaacatataataaatggtggagctgggatttgagccagatctgaccacctctaaaacccatacagttttcactggactttagcatttctcaaggacactgactttagttgtttttgtagtcaacagcaattttgtctatctcaaagcctctaaagacagattgggtgtccaaaaaaatgaatcccaaacttttctgattaaatatctgctttccaattgctctttgaaatatgagatagaaaatggcaatgctgatgaagatgaaatgaactcgggcagaagcctgagctgaatttgggaaagatgattagtggatcgaatgctggagaaaaacaacgaggttgtttgcctttttcctgctgtccatgtgtcattgaaaaggtggacacattcccacctgagaggactctaattagaaggtcttttggataaaaatctgaatgcaacagagggaccatgaattaaagtatatgtgttctctgtactgatctggtttcattagccactggaccacatctttctctattatacatcagggatcattacttagagtggcagtcaatgcagccactggctgagactagaaggcccattagacactgattcttagacttttttctccccaatcaagtaaagtcatgactttcagaaatgagtcattatatacgtttttaattaaccttaactgggtgccagctttcttcatataggtcagctttgacttaccgaatgtaatgtggctagattttttttcttcagggatgacatggctctggttagtattgcaaataagtttttgaactagacttgcccagcccagcatcgttttctctcaggaatccagcccaaattcccaccagaaggaatcttcctttcttctaatcactaccacgcacaaaatccatctaccttttgtgatatattcatcactggcaaaaatcagggaccatggaagctaaaaagcgctatgccagtaggactggctgttggcatgcttttccaagtaaagtgcttatacttttccctgtctctcactctgtcctcttaatggcagaggatgtggtgctaattttgctggtcagcaatcggaagagatcaatagcgaacagaggtgccaatttgtagaggaggtgttatttttaaacagcctgccaaactccagaattaaattgaggctttaagggcaaagaatggacaaaccaggtctaataactctttattctttccagtttcccatattttatcattgtcttgttttctaaatgtaagttgctctggctgctttcagagaagaatgggggaaggatgggagaggggtaaaggagagacggaagggggagagaaggaaagagtgtgaaaagctgcatgaattatcagggcccagaggatgacataataccaaccaataactttaaatttttggcagtgtctgtactgctgactctgttattggccagtccccagtgaggaagattatttaatgcaaatttatcatttcactgtaactctccagctaatacaaataaaatttcaacatttgctcaacattgcaaccaaaggtacagacagagaaaagacatcatctaatgcctggggtaatttctcctcaatcagatttctttcccaggacaaagtcattcagttttgctgctgtataggtcaggccttaggaaagaggtcccagatccattgagcattctctatattcatatgatgtgccctgtatgtggaataaatgatgctgggtgtgtgggagatggtttggttctgaggaaaacagtgtagaataagcgagatgattcctggtcttccagtccataggccaaagtgcactatccctatagggaaatatatgaagggaagggccaccggggcaagtgggagggacactggtattttcagaacgttccttcatattttaatttggaggaaaatgcatcccttttgtgttttcactactagattaccctgaggagggatagtcagaattttgttttttttacttttaagttcaggggtacaagtgacaagcacaggttcattacatgggtaaacttgtgtcatgcaggtttgttgtacagattagttcatcacccaggtattaagcctggtacccatcagttgtttttcctgatcctctccctcctcccaccctccagccccgataggccccagtgtgttttgtacccctctatatgtccatgtgttctcaccatttaactcccacttacaagtgggaacatgcggtatttggttttctgttcccttgttagtttgctaaggatagtggcctccagttgcatccatgtccctgaaaaggacatgacatggttcttatttttttaagcaactatttaaaatggaaatgggaggcaaatcctccttagcccagatttgagaggaaagagcaaacgagtagaccatgcacagtaagtaatttccaaacgattctttctcttcagcttgagatatttccatgaggtgagagtcacacattcttatatatatttacacccaaattactgtaccaacatttagatctttcccaagtaacagtgtgaaaccagcagctcagaagtatttataactgagatgcatgattggtggcacaataattgttttataaaatactacacctatcattttcgactgctgacttaaggtggatgatctgtataaaaaataaattatttgtgttaaggaaatggtgatgaaatatgggctttgtgtgttagtcattaatctttccatttaaatgcaaattttcatttcaatccctacctgaaaatacacctaataagaaacaaatttgattttctgatttattatttcagacaaagcctttggaatatgcattttcttttcatgggaaagagtgggttctatttacatttttcacatgtattttaaaaactcagccaaccaaatatcacttgcaactcaaacatgaaagttatttggttgaccaagagacatctagacgtatggttttgtgtgtttgagagacaggtgttgaagtggatatccactctcccttggtgatccccaagtcatggattactggggatcttggagttactgctggagtttgaaaaccctggtgttcaccaaacattatcttaatagtagaaaaagtatatcttgctatgtattttaatagtaattattagtattgcatagcaggaggtatcatattaaactctaagctaggttcattcagctgatcctcacagtagcccgttgacatagccattatttttatactcattttatagataaaaaggtgagacccagagagattaaggaactggtctaagtttatatggatgttaaattaaggataggttgacaccaatacctgtgaattcacctgtagaccatgcagcctttagagattaagtgttatttaaaggcatttctgatgaattgtttttcaaaatcaatgtttaaaaaaatgcggtcctcaagcatgagaaggctaacagcccatgctcttatttaatcaggacctacagttaatcaagttggttgttgtcagctgaattcttcctaaaactaggagatcaaaagagatgggcaagggagcaacccagagtgtgcagttcattcatgaactaacttacttttcactcagagaaaatgatacaagctttgggtcaggtgctcaagtattcatcagaaggttgaagaaaagagtcaactactaacaagccactctgtgaatatagtttttctgtttcttacaaatggccaggtcaagatgtcccaaaggaaaaaaaaaaatttacaaggtgaagtaaccaggaggctgaggtaggtggatcacttgaggtcaggagtttgagaccagcctggccaacatggtgaaccctgtctctactaaaaaaaataaaataaaataaaaattagtggggcatggtggcaggcacctgtagtcccagctactcgggaagctgaggcaggagaatcgtttgaacccgggaggtggaggttgcagtgagccaagattgcaccactgcactccagcctgggcgatagagtgagactccatctcaaaaaaaaaaaaaaaaaaaatcaagaaggtgaagtacagatcaaggtagaaaatgcagttgccaaggggtgcttccctctttagtaatataggggaaagaaatacttctgtaggctgccaccctggaaaaaaatgttagtactggagtgtcatctagcagtgtcctgttacgttactcagctcctcttctatcaaacctattaccagcttcacaggcttgtgggaaggctaagttagacaacttccacctagtaaatcctttagtgcagtaactgatagttgctcttgtcactgctaccaaatcccttccccaccctcacccccaccaacaaagtggtcaatgcaatgaagagaaagaggaaaatgcaactacttttttttctttttaggctacaatgagacatctcctatggctctaagaagctaggaacattctgtggtctttaggagagccatttagtggctgcaaatttggtcattataacaagaagagtcctgcctgctgtgcctcacccgtgctccagaaatcactccggtctctgacctcttcaatcttccctgtttttatttggtggtcggtccatgccctgccctgctctgagcattactaacccataagtgagagctgggaggggagtcagcctctaaaaacccagataattgtagaggttaaagcagttcacggcattataattaactgctgtattaggtgttttacaatcctgacaccaccacagacagaaaatgtttaatcagaactgaaagcaccttggaattaatccattttcatggtggaaattgcagtgaaggtatgaaatcaggcccaggcgggagaactagcccattttccttgcaggttgcatgctagtcactgtctttcctacagctggttacagctttaccacccagaactttctatgctgtgcaacaactttttgtgactacagcaaaatccatttatcagtcttacctggagtcagggttctcaacacgatttcacctatcagaattctgtaagccacaacctgtctacaaaaacagcctagcatgtggccaggtcaatctggaatgaggcttatgtcacccagtactgacactgatgcatcccctctgatcctcccagcaaaggcactgaggatcacctgtccccgctccccctggctagcacacctgactgaacaacaggaagaaaggaggagctggccatattccaaggtgtctgagccctgagttacaactgcttcctgctctgtgattccatccatagggcccatagcaaaacacctgccacaaaattgacagtccccaagtggttactcttttacaggcaccatcattttgctactgggctgggacaagttacttacctgctcaaatatcttactttctttattacaaaaataaccttgtgggacttaggtaagaaacagaggtaacagatataggatgcctaggacatggtatgtgcctgaaatcatgaatgagtagcatcgtgcaacagagggtgctcacaggtgtctgcttgtattattgcaacaaatatttgataaactttgtcctagaaacagaataaagatggtcctctggattgaataactgcattggtgtgctcagacaaatatatttgttgatttccaagcctctgaacttttgcacaggcaaacattacataattaattatatttaataaaagttagaaacctcaaaagatatattatttaagtcaaactttagtgcttactttaagaataggatgttttgtccttggtggtgactaccttgcagggagcccatttggacaggttgtacccattctgcaaacaatagatttctgcctgtcactgcccagctgatggacaatttaaaaatggtttctagtacctgtgaattgcagagctacctatgcaaacactttaccgtctcctaataagaagcaatgaggtctgcaatgcaatcaggtctggagggtagccgggtaatctatttgcacagtgtgtctgtccctgtctgtgaaggtgtttatttttagctctccactgtttctagcaccatccctcctttggagcctgacagcccatttgaggggccttaaacaagctgttgaaagcaagaaactgctgaaagtaggagtcagccgagcagccaagaaggtgattagagcaggattcaccttaggtgtccgaggtagaaaggtggattcagcttcggcttcgacagagtgtcaagcaagttggtcaacaaacttttaaaagccagccccagtgacactcgcctggagctttaaagaaataatgcctcagaggaccttggagtgtgagggcccctgggtacaaaggatggcactgggcatgtgacttctcacaaatggcagcaagctagactcctgagctcagactgcaaatgccaagggcagaagcaggaaaagaaacgctgagtcagtgacgtttccacagggccagctggttggtgcctgtttgggctaatttggggcatcaggaggtctgtgcttaaggtcacattcataatcgtgatagttagtgtcagaaggtgacacaacccagacagtccctggacacctgcaggggacagagctccaaggttatgaaagtcagcaatgacagatcttggagcaagttaagtcccacagggtcaaattctttgcagcaatgaaggtaaaagaggctgaggacattgcctttctaagtggtaccaagtacactgagtgccctagataaatattaaatagcagtgatgacatcataccacatcaagtgtgtcgttaggactcagtaagtctggttgagccagctcagtgtgaccatcagcagagggcctgaccccaaggatttttagtgtggaaggggaaaatgggaagcaaaacagcaaataccagagactgtaagagcagctgcatctctcaggcctcccaggcccacaaaagagttcatgaccacaagcactggtcagcaggctctctgcctgggtgttttgatttacagcaggcacaaaactgcaagtagtttcacagagtacccaggggaggcaaaggagatgagggaccttcctcaccaaggttcacaatcatatatggccctttaactgggaggcacttaaagccttggaggcaacggagaagcaagtggggagttgacttctcaagaacatcacaaaggaagaaataccctgctggtagatgttgcagaaagtattctcagctaatggtggggttttgaggagttgcagaaaccaaacattgacctctgaaaatggtggagcattttccctgagagtttcttggattcttctttctgtgcccaatcttcaggtggtggggtatccatcaagaggtggaatgatttgtccaggtcatgcagccaatctggctgaaccctgtcatatctcttagctgatggtgaaatgttttggacctctaactctaaataagtgacataactgaacatcaagtcactgaaagctaggggtcagtcatgggaagagcatggactttggaatcagagtgaacttggactcaaacaacaactccacattcactagctctgggaccttggcagagtcgtttagcctctgagtctcaggcttcatgtgtataatgtggagaaaatactgccagctttgtcaggctaagagagaatgtgtgtcaagcacttagtacagaatctggcagagttgccattcaattaactgcatttatcaatccatgttaattgcaatgaaaaccaacagggaattagaaccaaaatagctatctttcaggtcagaatctactgatgaactgaaacagaggaagaacctacaattgtagactgtgttttaaggtgcctaacatcatggcaactatttaagtatgtatggtggataattctctagagttgtatgttaaaagtgaacatcattatctcctaaatatttacaagttaatccattacatgaaagggtaagagaaaataaaagattctaggccaacgaaaagaactgtgtatgggtaggtgtttttttcaaccaaactgagaatgtggatagggaaaaataaatgagaacaagagagaccataaagatacgatacttccagctctgagtaatgcaaattggagaggaggacggattccaacaactgggatagatcagaagggaagagaagaatagaaaccacttggcagaagatctgagagtcaacagctaccacaaaggtggaggtgagtctctggagacatccagtctccacctgctgcctcacagcgtgatcttctgtgaagtgggaatcactagtgctactagaacaaagagctcatgcgggcagccaagcagcctccatctgctcaagctggaagcaggagacatggggaacacacaggctattaaatataaataacccgtatcgtcataaatattttatatggctgcatacagagaaggtaccatattttataccctcgctgtgaatctaaatattttattgttgccaattttgccattgacctcagctacagtgaggtatttgtggaggttgacattatttggttatatgaccaatgatcattcctgttaccatgtgacatgatcatctctcccgaggaaataatgggcatccattggcaaacactggacactgatgggtttgtttgcttttaagtgattctgagagatgcacaagtatgtgcacatattaaggagagggtttacttttagaatgaagaaacttgaggaaacttattaaggaagtagctttctgtgcttgattcaaatgaataaaagacaatacatttctgagtgggagccttgaaaagatttctattttgtgtaaaatgagagtgaattaatacacaaaatgtgctatatccatatgatggaatagtatcttgtgacaaaaagaaacacagtactgatatatgctccaacatgaatgagcctcaaaaacatgctaagtggaagaagccagaccaaaaataagaacatgtataattccatttatatggaatgtccaaaacaggcaaatccatagagacagaaagtcagtcccaaagcaagagggtctcaacaagaatcaaaatcccaaccttgcctaatgtcagagtggaaaaggggaataattaataatgtgcattgtggtttctttctgggagaatagaaatgttctaaaatcagattggggtaatagttggacaactctataaatataacaaaagctgaaatgtgcacttaaaatagatgaattttatggaatataagttatatttcaaactgttaaggtggaaaaaggagtgtgactttggctggatgctactggaagacctctttggaaaaaaggtagggatatacgttttgaagcctcccagaaaggtaataaaatgggggcatggggactggaaggctgaactgtggactctgttcctcatgattacagaagcatccttcatcccctgacaaagatgtgaccacagttcccaccagtttgccctgttcatatctggatacgtgtccttgtatgtgctgagacagatgatccagctaaagggagagtgagcaaaataaaactagatcagaccagtctcacagggtggggaggggaagcattaatagcaccaaaaggaaagaaaactggatcacaggtggcacagtcccaaggcaagagggtctcaccaggagtcaaaagtccaaattgagtgtaagccagagacagctgtaatacaagtagctttgagttctggtagcagcagagagcagaggtgtcaggggtcactgcacagcacagtaagacgtgccgcgcgctgcatcctcctgtcagtgtgacatcctgccagaagctgcaatccagctgattattcataaataggattgggaaacacacttgggtatttttccccatctgtctaattaaatggtaagtcccaaaaggcagagaccaagttgagctccagcttgtgctctcagcatagtttttggtgctggataaatagcaaacagtagtcttggaagaaaagactagcattttctacagggcctttgtagctgacgtgaaaagaagccctttgagtggagttgcagaagttcctcattgtttacttatttcttagtaagaggctcactcttgtcaatcacatttttcatttgtagtaaactaagctgactgaggattataaatgaaatagtttcatgttggagtataaccatgtaaagcctcagatgggaagtagttcttgttaaaactaagaagcaactgaggagtcactgcctcacatcacttcctctagaaagggctggcccaactcaacccaacacctagagaggtgctgtccaatagaactttctgcgatgtggacaggccctatgacatagaagacatatgtagctagtggctgccatactggacaacacagcactataggctttttagtacagaagattccgcagctttttgacaacgtgcactgaagtttattcttatataacagtgacaaattgacattaggtggcgggcacctgtagtcccagctactcgggaggctgaggcagcagaatggcgtgaaccaggaggcggagcttgcagtgagctgagattgtgccactgcactccaacctggacgacagagcgagactccatctcaaataataataataataatatcatgttgatctgtcaattcaacaagtatttactgtggactttctaagcgccaggtcctgctctaaactatggagctatctctgtaaaaaaaaaaatacaaataaaaaaaaaactggcaaggcccttgatttcaagaagtttataatctaatgtgcagaaataaacaagaaatatgaagcaaataaaggcatggttataaataataatcagtgttttcaaggaagcacagggagtgttgagagggagattgagcttctttcaaggcagaagtcagggaatgtctacccaaggaggtgggatggaggcttcagttggagaaatgggtgagaaggattgttttaggcagagggaacatcatagcaagaaaccccaggtgggaaagagcttaatgtgtttgaggaactaaattaaggccagtgtggctggaacacagtgggtgaaaggagaaaggaacaagatcatgttgataggttgggcaggagtcacttgtactgactctatttccagtatatcagaaggtcttgggaggatttcaagaagaatgacatcaatcagatataatgtgaaagtttactctgactgcaaaatagagagtacttggagaggggcgagagagagtagggacaccagttaggaggctgctatggtcaaaaagtgaaaggcagctggcgatgctataatctaagacatgagctgagccatgaagatgatggaagtggagtggatttgagaaatgattcaggaggagtaatagaactgaatgattgattggacattagagcaagaagatggagaactcagaaatacttctcaggtttccaggctgagaaactggtagactttggcctcattggcactattgggaatggaatgcagatctctcttcccacactaattctttgttgactctgcacgcccacagtttttttcctgatcatggaaggctggtgataacagggactgaacacgaccatcccatttagcaccgaggcatttctgtttccagacctatcactttaaagcatcttttacccctgaagcaagaatgagcttgaaaaacattttatattaaaaaaataaaaataaaatgcctgttacataatggcttcatttaactctaaaatccatcgtgttatagaactagaaacttctagagggtttgcttcattggttcccaatttttcagaaatgtgggacccctctgtaacagtgaagtccgcctctccgtatcatggtaataaaactgtctatctgcttcatttaaatgagatatgggctgaaagaaagatgctaaacacatagcctctgtggaattagattaaattttccatttaacctgctgagattatgaaaacagtctgacccacagggctgagggagttgcagcaattaccatcccattaagagttacaaaaacagtgggatttttgcaaaatcattgccccaggctttatatcaccagctttcgaactatgtcccagaaagattaagtacttacttaaatttaagggactacttaaagaaaccacaccctcctacttcttgactcccacttagcctcactatgcaagggtgaagggagagtctgcagccaggttgagtaatatttttctcatcctgaatcctgcgcagcccatctcctttttctgtgcctgatagaacacttaccatgggtccggcagggactgtaccaagacccttcatgcattatttcatttaatcttcacaaaaatttcatgagataagctttctttttttatgttattaataaatgaggatatgatactttaagttttaaagaataagcattttatttttggtacatatttattgatcaagaactacgtggtgacaaaagtgctataaattttagtgattgtagatgaatttgtatttcattcattccaacaatctctatctgcttgggaaattagttaccatgtcattcatttaatatttaaacagtatgtagaatgttatgggtttgaggcttcttgcaattaattattatggccccccccaccaggggtccttgggtcatgattgacatattctgatcaaaccaaaactacttgttctagattagaaaattggactttaaagaggacaagtgactgggccaagggcacagaacttgttgataacagagtggaggcatgcacctggtccttccatctttccattcacaatctttgccactatagcttctgcccttataaggtgaagatactagaaaaaaaggtgattacatcaggactggtgggagagttgtaaatgctatgaagaggagttgcctagagatttctgcagagaaggatcgtgaggcccaatctgtacttactggaaaacagtgcagtgattgattaataatgtctaccatgagttcatgtttgggagttaagtcacatgtgctatgtatttgaatgtgactgggtcaagtctttgtggcttttaggtggctttaggctggttatcctcatggcatggagctgtgctccattttcttcatggtggtcctggccataaaagccttaagaagtctggcgtagtggcatacagctgtagtcccagctatttgggaagccgaggcaagaggatggcttgagggcaggagttccaggctgtagtgtgctatgatggcacctgtgaatagccactgctctccagcctgggcaacatagcaagaccttgtctttagaaaaatataatttttttaaattggacttttaaaaagtctttagaaaagaccaacagaattccactagctctgggcactgaaggaaaatttccatctcctttccatcttactcaccagcctatgttattttgctacaatcagatactagtaaaaaaattctacgcagttaaaaattgagcactgttgcagttcctagatggctgaataggaacagctccagtctatagctcccagcatgagtgacgcagaagatgggtgatttctgcatttccaactgaggtaccgggttcatctcactggggcttgttggacagtgggggcaggagagtgggtgcagtgcactgagcatgagccgaagcagggcgaagcatcgccttacctgggaagtgcaaggggtcagggaattccctttcctagccaagcaaagctgtgacagatggcacccagaaaatcgggtcactcccaacctaatactgtgcttttccaatggtcttagcaaacggcacgccaggagattatatcctgtgcctggctcagagggtcccacacccatggagccttgctcattgctagcatagcagtctgagatcaaactgcaaggcagcagcgaggtggggggaggggcgccccccattgctgaggcttcagtaggtaaacaaagcagccaggaagcttgaactgggtggagcccaccacagctcaaatgggcctgcctgcctctgtagactccacctctgcagggcatagctgaacagaaggcagcagaaacctctgcagacttaaatgtccctctctgacagctttgaaaagagtagtggtactcctagcatggagtctgagatctgagaacggacagactgcctcctcaagtgggtccctgacccccgagtagcctaactgggaggcaccctccagtaggggcagactgacacctcacatggcagggtacccctctgagacgaaacctccagaggaacgatcaggcagcaacatttgctgttcagcaatattcattgttctgcagtctctgctgctgatacccaggcaaacagggtctggagtggccctccagcaaactccaacagacctgcagctgaggatccagactgttagaagggaaactaacaaacagaaaggacatccacaccaaaccccatctgtaggtcaccatcatcaaagaccaaaggtagatacaaccacaaagatggggaaaaaacagaacagaaatactgaaaattctaaaaatcagagaacctctcctcctcctaaagaacgcagctcctcaccagcaacagaacaaagctggatgcagaatgactttgacaagttgagagaagaaggcttcagaccatcaaccttctccgagctaaaggaggaagttcgaacccatggcaaagaagttaaaaaccttaaaaaaagattagaagaatggctaactggaataaccaatgcagagaagtccttaaaggacctgatggagctgaaaaccatggcacgagaactacgtgatgaaagcacaagcttcagtagccaattcgatcaactggaagaaagggtatcagtgattgaagataaaatgaatgaaatgaagcaagaagagaagtttagagtaaaaagaataaaaagaaacaaacaaagcctccaagaaatatgggactatgtgaaaagaccaaatctacgtctgattggtgtacctgaaagtgacggggagaatggaaccaagttggaaaacactctgcaggatattatccaggagaacttccccaatcgagcaaggcaggccaacattaaaattcaggaaatacagagaatgccacaatggtattcctcaagaagagcaactccaagacacataattgtcagattcaccaaagttgaaatgaaggaaaaaatgttaagggcagccagagagaaaggccgggttacccacaaagggaagcccatcagaataacagctgatctctcagcagaaactctacaagccagaagagagtgggggccaatattcaacattcttaaagaaaagaattttcaacccagaatttcatatccaggcaaactaagcttcataagtgaaggagaaataaaatcctttacagacaagcaaatgctgagagattttgtcaccaccaggcctacccaacaagagctcctgaaggaagcactaaacatggaaaggaacaaccagtaccagccactgcaaaaacatgccaaattttaaagaccattgatgctaggaagaaactgcatcaactaacgaacaaaataaccagctaacatcataatgacaggatcaaattttcacacataacaatattaaccttaattgtaaacaggctaaatgttccaattaaaagacacagactggcaaattggataaagagtcaagacccatctcatgtgcagagacatatataggctcaaaataaagggatggaggaagatctaccaagcaaatggaaaacaaaaaaaggcaggggttgcaatcctagtccctgatgaaacagactttaaaccaacaaagatcaaaagagacaaagaaggccattacataatggtaaagggatcaattcaacaagaagagctaactatcctaaatatatatgcacccaatacaggagcatgcagattcataaagcaagtccttagagacctacaaagagactaagactcccacacaataataataatgggagactttaacaccccactgtcaacattagacagatcaacaagacagaaagttaacaaggatatccaggaattgaactcagctctgcaccaattggacctaatagacatctacagaattctccaccccaaatcaacagaatatacattcttctcagcatcacaccacacctattccaaaattgaccacatagttggaatgaaagcactcctcagcaaatgtaaaagaatagaaattataacagactgtctctcagaacacagtgcaatcaaactagaactcagggttaagaaactcactcaaaaccgctcaactacatggaaactgaacaacctgctcctgaatgactactgggtacataatgaaatgaaggcagaaataaaggtgttctttgaaaccaacaagaacaaagacacaacataccagaatctctgggacacatttaaagcagtgtgtagagggaaatttatagcactaaatgcccacaagagcaagcagaaaagatctaaaattgacaccctaacatcgcaatgagaagaactagagatgcaagagcaaacacattcaaaagctagcagaaggcaagagataactaagatcagagcagaactgaaggagatagagaaacaaaaaaaccttcaaaaaatcaatgaatccaggagctggttttttgaaaagatcaacaatttgatagacctctagcaagactaataaagaagaaaagagagaagaatcaaatagatgcaataaaaaatgataaaggggatgtcaccaccgatcccacagaaatacaaactaccatcagagaatactataaacacctcaatgcaaataaactagaaaatctagaagaaatggataaattcctgggcacatacaccctcccaagactaaaccaggaagaagttgaatctctgaatagaccaataacaggctctgaaattgaggcaataattaatagctaaccaaccaaaaaaagtccaggaccagacagattcacagccgaattctaccagagttacaaggaggagctggtaccattccttctgaaactattccaatcaatagaaaaagagggaatcttccctaactcattttatgaggccaacatcatcctgataccaaagcctggcagagacacaacaaaaaaagagaattttagaccaatatccctgatgaacattgatgcaaaaatcctcaataaaatactggcaaaccgaatccagcaacacatcaaaaagcttatccaccatgatcaagtgggcttcatccctgggatgcaaggctggttcaacatacacaaatcaataaacgtaatccagcatataaacagaaccaatgacaaaaaccacatgattatctcaataggtgcagaaaaggcctttgacaaaattcaacagcccttcatgctaaaaactctcaataaattaggtattgatggaacatatctcaaaataataagagctatctatgaccaacccacagccgatatcatactgaatgggcaaaaactggaagcattccctttgaaaactgtcacaagacagggatgccctctctcaccactcctattcaacatagtgttggaagttctggccggggcaatcaggcagaagaaagaaagaaagggtatttaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaatcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggacacaaacaaatggaagaacattccattctcatggataggaagaatcaatatcgtgaaaatggccatactgcccaaagtaatttatagattcaatgccatccccatcaagctaccaatgacttccctcacagaaatggaaaaatctactttaaagttcatatggaaccataaaagagcccgcattgcaatcctgagccaaaagaacaaagctggaggcatcatgctacctgacttcaaactgtgctacaaggctgcagtaaccaaaacagcatggtactggtatcaaaacagagatacagaccaatggaacagaacagagtcctcagaaataataccacacatctacaactatctgatctttgacaaacctgacaaaaacaagcaatggggaaaggattccctatttaacaaatggtgctgggataactggctagccatatgtagaaagctgaaactggatcctttccttacaccttatacaaaaattaattcaagatggagtaaagacttaaatgtgagacctgaaaccataaaaaccctagaagaaaacctagggaataccattcaggacctaggcatgggcaaggacctcatgtctaaaacaccaaaagcaatggcaacaaaagccaaaattgacaaatgggatctaatgaaactaaagagcttctacacagcaaaagaaactaccatcagagtgaacaggcaacctacagaatgggagaaaatttttgcaatctactcatctgacaaagggctaatatccagaatgtacaaagaactcaaacaaatttacaagaaaaaaacaaccccatcaacaagtgggcgaaggatatgaacagacagttctcgaaagaagacatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacagtgttggtgggactgtaaactagttgaaccattgtggaagtcagtgtggcgattcctcagggatctagaactagaaataccatttgacccagccatcccattactgggtatatacccaaaggattagaaatcatgctactataaagacacatgaacatgtatgtttattgtggcactactcacaatagcaaagacttggaaccaagccgaatgtccaacaatgatagactggattaagaaagtgtggcacatatacaccatggaatactatgcagccataaaaaatgatgagttcatgtcctttgtagggacatggatgaagctggaaagtatcattctcagcaaactatcgcaaggacaaaaaaccaaacactgcatgttctcactcataggtgggaaatgaacaatgagaaaacttggtcacaggaaggggaacatcacacactggggcctgttgtagggtggcgggagggggagggggagggatagcattaggagatacaccaaatgtaaatgacgagttaatgggtacagcacaccaacatggcacacatacacatgtgtaacaaacctgcatattgtgcacatgtaccctagaacttaaagtataattatatatatatatatataaaaattctgagcactatacaaaaaccttccttgacaaagaaacagaggttatgctgaattgtgaaaaattttgatcgtgataattgggagtaccccttgacattttttcaaaaatttaagttgaaaaactaaaaatataacttttcaatgtttctctgctcccatttacctccaaactggcaattgattgcccttacatctgaatacacagctgggtcttgaagtagcattaggaaaatagaatttccagtagaaagcctgagtctacccacagacggggtattgaccagaaatataagggcaaagtaaattccattactttcagtagagtttaacctataatcttcacccaagcatataggcacctcagaataagagaaagaacttataaaaaaattgattgtgttaccccccaaaaagagaaagccagcagctggttttggggagggctaaaatctgtttctgtcagcacaggaactaccatcttggaaccgtgaaagaaatgaaaatcaaggcgaaagttaagtacttttttccgatgacctggtgtaatgattaaaatgctgaattgcttttttaaaaggtttttccactgaaagaaagaatgtcagagccttccccctgactcaacctctgctcccttctttccaaatgactgtgaaagaaaataaaatggaatatatatttaaatatttttttcttcataaacaattcgatctcttttatctgaaagttttgccaatgttttcatcagttccctcagagatggctgtgattccactttttctttgaacaaagaataaattgagtttctttgcagtgaaaaatagaaggcttgctaaaagcactgacttcaaaatagtgcttattgcacatttagagaaagcatattgaaaaacagtgctcatgccgcctttaccgagaagcccgctttggcttacattaagctgccagcatcttctggaaaaaacaaacaaacaaacaaaaaaaccttggcgatatgctaagctagagacggtgttggtattttcctttgaaaatacctctgtttctcagtcatttatttgtgcctccattagcaatttatttttaattctgcattctatggaaaaagcatattgctggaaaacaggcacatcttacatgcatatgcctgacattttaaaaaatgaatgtaacgccctccacgctcaaaataaacaagctgtttttccctttccccacacaatatttatgaacctccaggagattgctaatgcatttaacaccgccagcacactagtccttgccatgtgactcctttgttcttttgaaagaactgtgtccctggctcccagagtcccaccctgacttcccaggatcaggagtcactggccatcaggtaggtgaccttctcctggtgacctgttggattcagaacagcaatatttcaaagttaacccaagaaaattcttgaagcttgcatatttccaatgaacagtagtgtttactttttcgatagtgttaatctgccttctctacgttctgcacattaaagaatagttaaaatcatcaggcagatctgagatgagtccctattccattattctctgaaatcccgggcaagaaacttttctgagtcttagcttactcatccatatttaaaatttatactgaaatttatatgtatacacacacctacattaaaaagttatttgtagggattcatgagaaaatgcttgtagagtgcttagcacagggctggacttgctaataattattatttgctaaaccagtgattagataacattattgacatttataaataacttcacattttacaaagctgctatcctgaacagcatgtgaaaagcaattggtgtccacattaatattgtttttctttaaatgtcattttaatactacagatcaattacctgggctagatgtcttagcctattccaaaatagatagactgtaaccaatcctatttcctccagggtcccgacctactgggcggtcgtgatgttctaaagaaagatggccactgctataaatattaagtgctatggtttgaatgaccctgtaaaactcatgttgaaatttaattgccaatgtaacagtatttaagaggtgattaggccatgagggctctgctttcattaatggattaatgctgttggcacggagtgggtttctgataaaaaggatgagttcagcccaatttcctttctctgcctcctgtgcttgcttgcccttctactgtgttttgatacagtaagaaaggccccactagatgctcacgccatgctgttggactccacagcttccaaaactgtgagaaatcaatgtcttgtcttataaattacccaatctgtggtactgtgctatagcagcagaaaactaagacactaactttgggttgagtcttaggaactcaagccactgtaaaaaaaaaaaaaaaaaaaaaaaaacattttcttctagtaattaaaacaaaaaaaatctgctaagcaaattttttatttatttagcttggattaacttaaagtacgttttcaagttgagtgctagtatttcttcaattccagaaaagtataagccttatctttttgaaaattgctttcccctacattcttttttggagcttctgtgaaatatagatctggacttttccatctgtcccagttggtcttcatctgtattgcattctgaatgttttcctcaaattcagttagccaattttttttaggtgtatctgatatgttgttcaacatgctgattgaggtcgtaaatttaatgattgcagtcatctcttagtatacccagggattggttccaggactctcttgtataccaaatttcgtgcatacgaagtttgcacgttggccctttggaagctgcatacacaaaaagtcagcctgccatataagtgggtttctcatctcaccaacactgcattttctatctgcattgggttgcaaaaaatctgcctataactggaactatgcagttcaaactcatgttgttcaagggtcaactgtatataacgtattcccaattatttggttctcttttaaatttttatgatctttaaaaaataatgtcttgttctttcactagggtttctatgacgtctttatctttgatgcttttgaacacattgattttatactttcaattaaactattacctctagttcttgaggtactaatttcctgttatacagctggttctccctcatggttctgtgttttcctgggcagatcatcttattttttaaaaattaggcttatcattggagatggggggtgggaacttctttgcaagttctttatgtcctggattataaaaatattcctgtggaccagttaaacacttgattctcctgcacttttctatatttatgtttatgttcatttctcagcttgagattctcatttcataggttaatttggaccctacatctgatcatgtgatttagtctgtgggttttactctttctatgtgtaactatttctccacctataactcccttatagttttatatggtgcaatattaggccaacagggtaatttttctagtcttttactcatagaaagaagaatatttgaaggctccagtatttttgttttgggcttacttctaacctccagcctctcattatccaaaaggtcaccatggcatcatgtctatttagattttgtggccctctttgtttctagacatctggggatcccttgcaagctctactatgtatatacttgttttgttgtttttacgtttcacccttctattcctcgtgcaacaggaggatcggttcagtgcactgagttgacctaagcatcttttcttagagagcacttctcactactgtatatcacttaggtctgcctgcctataactcagcaaaattgcccactcaaagcactgagaccagaaccaatttaatgccttgattacaactctggaccttttggtgaagcaatgcttcccattttatttaatgagttgtcttgaattctaggtttattttgttgaaaaaccctagatgtttgatcatttaaaaatacaaaaaacaatttctcacaaggatgcctttttacctgaaggataaactgggaggcatttctttctgcaaaccagctccagatgatctcagcatctaaagaaatttaaaaagttgttttccccctaatttaatcagcattacaagccagtgatggtgttttcagcaataaatagatcatctcactactggcctaatgttttcagagagtatcctaggtgatgcataaattatgaaattgttatgaaaactttgactagaagggcttaacccctttcttattgatgaggtgatatccaggcatttttattgtccttaaactatagaaatataatttgggctctagaagtgttctgttgtaacaaaaatgaaataatccaaactttttccctctcttaataaaaattccccatgacctgaaatagtcacatttccctatggtggaactagcatgaaggtcaagagttagaacctgagagatggtgtgggagggagtgaggcaggtagagaaagaaagatgtgtttaggtcttttgtctagctcatagtacagtacggccaggactagggtaaagcaaatgagatccttgccctgggcaggaaatgcaaagcaagtctaggaaacttagtaattattatagtattttaaattaatattaaaaatatgttaattcacttgattcaatcattccataatgtatgaatatatcaaaacatcacattgtgctttataaatgtaatacaattatgatttgtcagttaaatagtattaataaaaataaatttaaaattaataaaacaatattttaaaaaatcaaattggcaaactgtgagccatggactgtcacctgcttgggtaaataagattttataggaaccagggctgcatcatgatgaggtaaatgagacagagttgtccaaatgcagggtcaatgaggtataacagttgtcccttattatctgctggggattggttccaggacccccacagacaccaaaatcctgtgatgctcaaaacccttacataaaatggcatagtatttgcacacaacctatgcacattcttgtatatactttaaatcatctctagattacttataatacctaacagaatgtaaattctatggttagattgtaatttttataatttttttcttgctgttattgtttttttctgaatatgttcaatgcatggagggccatctgtagtgtccttatttaaaatttgatattttgttcatcattggatttttgcattgcttttgattttttaagtcattgccttaaaaatatcatttatctcgactacccccttaaattttgtgcccaagaggagtgcctcacttacgtcaccctgttcctagccctgagatgggaagatatcacagagaaatggtgatgtctgagctgttacagttgcatatacaagcatcatagcaacattctgggatgtatgatcttcatcagggtgtttaactcttggttttcccaccatgagatgggggcagtaaaagtacttactttacagggttatactgaggattaattgtagactgctcagcacagtgcccagtacactggttcagtaagtatcttagtccattcagattgcaataacaaactaccatataccgggtggctaataaacaacagaaatttatattcttgtagttctagaggctggaagtctaagttcaaagcgctggtagattcagtgtcaggagaggacccacttccttgttcatagatagcatcgtcttgctgtcttcttatatgccagaagggtcaaggcagctttctagggcctcttttatacagggaataattccattaatgagggttctttctgcatgaccaatcacctcccaaagatcctacctccaaataccatcacattggagattaggtttcaacatatgaattggtggagtggggcaaacatttagtttatggcagtgagcataagttagtagcagcaataatagaaatgaaagataagtttttaaagctctaagcaaaggcagattggttagggccttgattaagatttttttgttatagtaaaatatgtataacgtaaaagttattttaatgattttaaagtatacagttctgtgatgtaagtacattcacatttttctgcagtcatcaccatcgtccatctctagaacttccaaaaatgtcaaactctatccaggaagcttttaaaggaccactggaggttgtggagcaggaacctggcctaaagaagcatgtggctaaaatgaatctgagaaaagcatctagatgatacagaggaagacaggaggcgggaaacaggagggtcccacagtggtctgagtaggaggtggtgggctttgactaggaaggtgacaaaagaggtaaggaagaagaacagaaaatggaacctcattagacaagaagggaagaatggaaaggaatcaaatgggtgaggtgatattttgaaacagaatacaattaactgaaaagttccattaggcatagaaacagtagagctgggggtcagacagctgcttctcttgcaaagtggtctgctgccaccggctcctgctggcagagctgattctttaattttcagaaatgttatgagcctactgttaaacattgccataattaaaaattaaattaaacttaaaattaaataaattacattagaaacaaaggttataactgaatacccatcactccttaattactttactacatttcactattatctctgcttctgaagttatttaaatctatcctatctgtatagtaaaataccatataacagcatgctactgcccatatcttctcactgccacattcattgacatccttttggtaacctgaaactggctgaggtgggagtatttacaccaggaaattggcaagggccgcaaattagggcttgattctttgttgtctatcgcaatgttgataatgcacttaaaagtgtgttgcatctgtagctattatactaaaactgtatgttaaatcaaggtcgaatggctaagaaattataatgagttcagcaaaaaacgaaagcagtctgagaaaatcaattggaacttacagaatattgtatattttgttatttataacttacatgatatatgtccttttatcagtaaaatttgtaataaacttatatttgtataaatgcatactgttggggagtcaattgttgaacatttactagtacaccactgaccatacttttctctgataaagagatttattgtataacatctgtttatattccttctgaaactattccagtcaatagaaaaagagggaatcctccctaactcattttatgaggccagcatcatcctgataccaaagcctggcagagacacaacaaaaaaagagaattttagaccaatatccctgatgaacatcgatgcaaaaatcctcaataaaatcctggcaaaccgaatccagcaacacatcaaaaagcttatccaccatgatcaagtgggcttcatccctgggatgcaaggctggttcaacatacacaaatcaataaatgtaatccagcatataaacagaaccaatgacaaaaaccacatgattatctcaatagatgcagaaaaggcctttgacaaaattcaacagcccttcatgctaaaaactctcaataaattaggtatcgatgggacgtatctcaaaataataagagctatctatgaccaacccacagccaatataatactgaatgggcaaaaactggaaacattccctttgaaaactgtcacaagacagggatgccctctctcaccactcctattcaacatagtgttggaagttgtggccagggcaatcaggcagaagaaagaaataaagggtattcatttaggaaaagaggaagtcaaattgtccctgtttgcagacgacatgattgtatatctagaaaaccccattgtctcagcccaaaatctccttaagctgataagcaacttcagcaaagtctcaggatacaagatcaatgtgcaaaaatcacaatcattcttatacaccaataacagacaaacagagagccaaatcatgagtgaactcccattcacaattgcttcaaagagaataaaatacctaggaatccaacttacaagggatgtgaaggacctcttcaaggagaactataaaccactgctcaatgaaataaaagaggatacaaacaaatggaagaacattccatgctaatgggtaggaagaatcaatatcgtgaaactggccatactgcccaaggtaatttatagattccatgccatccccatcaagctaccaatgactttcctcacagaaatggaaaaatctactttaaagttcatatggaaccaaaaaagagcccacattgcctagtcaatcctaagccaaaagaacaaagctggggacatcatgctacctgacttcaaactatactacaaggctacagtaaccaaaacagcatggtactggtaccaaaacagagatattgaccaatggaacagaacagagccctcagaaataatgccacacgtctacaactatctggtctttgacaaaccttacaaaaaccagcaatggggaaaggattccctatttaataaatggtgctgggaaaactggctagccatatgtagaaagctgaaactggatcccttccttacaccttacgcaaaaattaattcaagatggagtaaagacttaaatgttagacctggaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaataaactaccatcagagtgaacaggcaacctacatagtgggagaaaatttttgcaatctacttatctgacaaagggctaatatccagaatctacaaagaacccaaacaaatttacaagaaaaaacaaccccatcaacaagtgggtgaaggatatgaacagacacttctcaaaagaagacatttatgcagtcaacagacacatgaaaaaatgctcatcatcactggccatcagagaaatgcaaatcaaaaccacaatgagataccatctcacaccagttagaatggtgattattaaaaagtcaggaaacaacaggtgctggagaggatgtggagaaataggaacacttttacagtgttagtgggactgtaaactagttgaaccattgtggaagtcagtgtggcgattcctcagggatctagaactagaaatatcatttgacccagccatcccattactgggtatatacccaaaggattataaatcatgctgctataaagacacatgcacacgcatgtttattgcagcactattcacaatagcaaagacttggagccaagccaaatgtccaacaatgatagactggattaagaaaatgtggcacatatgcaccatggaatactctgcagccgtaaaaaatgatgagtttatgtcctttgtagggacatggatgaagctggaaagtatcattctcagcaactatcgcaaggacaaaaaaccaaacactgcatgttctctctcataggtgggaattgaacaatgagaacacttggacacaggaatggaaacatcacacactggggcctgttgtggggtggggggagggggagggatagcattaggagatatacctaatgtaaatgatgagttaatgggtgcagcacaccaacatggcacatgtatacatatgtaacaaacctgcacgttgtgcacatataccctaaaacttaaagtataataaaaacaaacaaacatgtgtttattattatatccaccttaaagctgtctttgcaaaagacaaattgactcgttccctggtcaaaatgaaaaactggacacctcctctacctaataaacactgtaatggtttttctgtaggcaaaccacagcaattgattgaaattgacagaaaaatgattatttttcactgtaatcgctagccttagttaacatcttttgagcaccgctatgtaccaggcactatgcaatgtgttttattcatatttcaatcctcgctcccctatgcaaagtaggtcctcatgttatccccattttatagatggaaatatcaaggttgtataattagtaagtggtaaggtggggatttgaaggcgacctttctgattctttctgatctcttcattgtgatacattctctactatgttgtctccaactgtttatatggaggtaaaatcttcacttcaaaaaacatcatatattccaggcaatagttattgatcaactactacattcactgtgctgtgctgggtaatcacaggaaatttctcaggacagtcacctgagaagtatacaaagtggcctctgactcccaggaatccattctgtttacaagggtgcttatataatcaagtgtccatgtgtcatcactagcaagtccacttccacagttggaagactgacttcccaaacaagctgcactcagctgatcctggttggcttcacttgctccaaggcccagaccctcttttctcaagtgtcttatactcatcccctaaatctcccttgaagaattcatgtgcttctcctcccactcagtgctttctaaggaagttaaatgatgatgcagaaatcaagcagcaggtacctccagccaggaggtccttactggttgcacaattacgtttagttacagaacctttgaggagtctcctatcaaaattttgtgttgctgtgtgtgctgtcagctgattcacctgagataggtccaaaatgagaaatttcaagggctgttgagcactgttgttttccaagctgattagtacaaaagcattcaacattggagtcctggaatcctagatacattggaagaaatttttcagcactggatggtcctaaaacttccccttaccccaaaattccaaggcaagtccaaattcacaaatacctcacgaacaaatggcagaaactgggaggtggtccaaggattctggttctctctccctattttctctttcttcctgtctccacctaccaagataacttccttgcttctgcttcaaactaggccactaattacgagagaagtcagaaatagtgttgatatatgtctgtgatgtaaacagaagctcagatgaagcaagacaggaaggtatgctaaagatagaaaagagatccttctgttcatcagtggctgaaaaataaagattctagaacatgaaaaaaacataaataagccaaatagaaataaacatgtatgtatgtgtgtgtaactaagcaagtacacttataatagcattaattccttttgtctccagagaaaaagagggagggacatttgcaaacaggagtgcccactatttaaatgtccatgtggttgtttggaatcatgtaaatataggctgatgcttgtctttgagtggtctatagcctacatttccaaaaatgggaagtaagttctgtttatgcaaagtcgtaagatcaccaaacatgattgttttcccattcaccaacatctttgtgccaggcatggagtaagtgctctgagtacatgatcccactcactctccccatcaacacctttaggaatgtggtgatcattttacattacaggatgctaacggtgagatagctcaagttgtttgcccaatgttatgtacctggcacaaggcaaggctgggatttgagcccaggtctgtctaattctgggccctgggcacttagcctttctgcaagggctgagaaaagggcctggagaccacacagacctggattcaaattcaaagccccctctgttgcctcctatattactgtagtgtagtggtggtggtagtttactttcccttcttgagcctcactttccttcactgaaatagaagcaaccttgtagtgtattgtgacaatgggaaagaatgtgagcaaggagcttaaaacaagacttgggctgggctcagtggctcacttctgtaatcccagcactttgggaggctgaggtgggcagatcacgaggtcaggagttcgagaccagcctggacaacatggtgaaacaccgtctctactaaaaatacaaaaattagcagggcatggtggcacatgcctgtagtcctagctactcaggagggtgaagcaggagaatcacttgaacccaggaggcggaggttgcagtgagccaagatcatgccattgcactccggcctgcatgacagactgagactctgtctcaaaaacaaacaaagaagacctggcagatagctaacattcggtaactagcaattgtgattcgtgtaactaattctgctgtgaaatggtgcctgatcttcaataggcaaactttacacataagtaaagagagagttattttaaaaaacccaattcatctgacatccatttgtttattcgtttgtttagccattcaacaaatattcattaagcatccaccctggcatgagttgttttccttggtgctttatgtgttgcttaaaaaaataagacgacaatcacctgaaaaccacaccatgcagtaggtgtgatgtctgagccttcaccatctcaacttctcacaccttcttttgtatttcaggcactgggctaggctcaaggatggactgaaggcacttcctgccatgtcagggatgaggggctcatggtctggccagaggcagcaggcagcattgcaaggagtgtgggcagaatgttcgaaggagagggagagattgcacatacacaagactgcacctcggagataacttttgaaggtgtttcgggtgtgagaggaggcgtgacaggcctagggagcagtgagaaacccagcttagttgaagcatcaggtgcaaggcagcttgggggtggagtgtccatttaccctttggaatacagtcttcctgttggcatggcaactgctgcaaaataaattcaaggtggtacttcaaatgatgcctctgagactgtccaggagtcatttaaattgcttgtttgttatgtatgacaatttgcctaacctccaacctgcaattgtagcttggcaatcttttgtttattgtgctgatgtgctttcttgcatcatcgtcttccttaaacctcttttttggtttgtttttattttgcccatctagaaaatatacgcaggcattgtgttgattttcccaggctcccttgagatcgtgcaggccttccatctcttcatctgatgaaaatgctgccagggtgatgtttacaatctcatttttcaccccaggatccctgcactcagctgtggtgggaatcacagtgtgctcagccagccgtgtcccttcttcccatggaatttttggaatttgggctgctcataggggcacagaagcaccagctacattgctccttctatgctggggaatgacagagtcagtgctcacactatgaatgtctcccagatgtacacagctgccctacaggccgacaccacatgcttgccatccctgactgactctaagtacagaataaaaaagaattcatgaaaaaacaaataaataacttagggtgccttttcccatctgagattctaaagcaaacaaaagtcctggcttcttaggtcagtggtagatttgccaaagcaaaataaatgtctgaatctcctctggttcctgtttctcctaagcatgtgtgtgtgtgtgtgtgtgtgtgtgtgtgtgtgtgtgtgtgtgtgtaaggaagacagagacagacagatgggggctggggaggctggatggagggaatgtggcttcagcttgtgccaggagagtttatctgtcttcccttctagggaaactgaatataaaatccttaggcataaaaagaatctttcatatgtagactccttgggaattcaattcacactcttctgtactttctttctcactgtttcttttgaacttgacggaaaaaatttcttatgctgttcacttaccttgctctcagataaagaagagagagagagctaaggtgcttaaatgtcaaggtttgtaaaattggcaaactggccccatgaggtttgtggtttgaatgatgggtctccatcaggtttggtgacaatgatagtgaaggagtctaagctggtaatgtagcagatgcttttttggcccttcctctgtttcagtcactgttctgagatctatgtgtgcattaattcatttaatcatcccaatgaccttaggaggtaatggtgttatgattgatgctattgttaaattaccttacttttttgcagatgaggaaactaatgtctgagaggtaagtgttgtgcccgagttctcatggctaagaagcacaagagcttaaatttgaatccctgcagttcgactatagactgtggttctcaaccaagggcaatttgttcccccaccctacaagacatttggccatgtctggagagattttaaattgtcatgacttggaggggtactgctactggcttctagtgggtagaggtgagggatgctgctcgatcgtgagccccgtaatcaagaattatcaacccaaaatgtgacgattgccaagtctgagaagccctgctctgcagacaatatgtctcagagttctggtgctgatcagacagcacgtttctggggctcaatataggcgagccagagataatgcccacagaaaagggaattgtaattaggagaggatgatctttggcagtatgcatttgtgagcagacactcctgaaaggacagggctgagggtaccttatggttctgtttctcccttaggatggcagcatctgataaccagatacaaaacctgagaggaaatttttaagctgtgactagtctgattcccagctggccagctgagccaccctacttctgtgttttctggtgcaaagaacaaggttctaccgagtgaccttagacttggcttctggataaaattgtcagagagctcctagcattttgcctgagccatcacagggaacctgggtttggaatctcaaccactcatggcaaagttattttcattccccttgctctcacctgcccccatgggaatcttccataggagaaatgttctaattgggctcattagaaaatatagttcatgattttgtaagaatcaaccgtaaaagaagggtgacctttgaaatcctttgctggctcatttaaaatgcattgaagaggggaatttcttttgagcatcatcaatgcagtttggttttaaagtgttccaggagtcaggccctctctctgggctccccagggacttactcctgctgacccagaagaggttagctttaccatcccctcccagtttactacattccacctaaacttccactgtacttttggagaattgcagtcatgagaccagcagtcttggcatcacttgggaatttgctgtttatctcaggttgtaactcagatctcctgaatcagaatctgtattttaacaagattcccaagttattcatataaactaatctataaagttttgttttttactctaaaagttgttctctaggaactgtgagtccaagtggatggcagatttcctctctcagtctgattctgaatttttagaatgtggacattctgttagctgagctccaaggcactgttgcagctcaaaaatgttgtgatggcccagacttctgtagccaaagagttcccaaacagtcctaccaatacacctaggcagagatgtttgagctgctctaccaatgatatttcatacactctcagttgaccatcaggctctttgcctgacctgtcccactgagaaagaagatttcctgttaaccgccactctattttggctgtgacaggttgtcacttatttgatctgacttcttccatcaatcagcagtttctcagtccagttgccatgtctctcagggcatgtgagttaatctacttctcggtcctctacttttattgggactgacatcatctcaatatactcttaaaagtgatcccaagtttctaggttgaggcccagcttcaaaaacctcattccagggttcatgaatgcctggatctattcatctgaatgtttgcacaagttttaagatcaccatagtgtgaggtttattcccctaacctctctatttagctagaaggcagtaggctgtgcctgtacccaccaagcaggtggcattgtcatacagacctcaaccagaaagggctggtgccctggttgatgatgggctcatcaaagaggtgtaaagtttcagaatgaagggggttacaaaagcaaatgtcaacagaggccataagcaatggggctggggcctattgacacaggacctgggagactgctgtgaccacaggtgagggtgggaggacagcagatgcagattccagatggtttttcccaggaataagggcatgcccagggcctttacatgatcggatctttttcaaagggagtctgaaatctggcttatgacatcttcctgtctttaaaatattggtgataattcaattttctttcttaaacacactaagcaggcaaaaagaaaaacatctgcagggtggagatgctcgggtagggacaaatcagtcctcatgtcttgattgagcctcttccagagctccagcaccttgtgtttttcaaagttcagtttctggatctgcagtggcagaattgtacagaatgaccatatgccattcctagtccctgcccaggacagccagaacccaaattctgtagatgattcctgggaatttgtccttcattgtgcttctgagggtgcagaagtgtgattgttataaagccaggtgatacgcaaaataccaagagatgtaaaagcataacctcaccttagggcccgagaatctactaaagaaaatatgattattatatatgaagtggtacatttaaaaaccagcatgatgagagtacgtgtgtagaatctggcccaggactggggatcactcagatcagttgccttaagcactaggcaatgaccagtttccttggaattttgaagggggctgacctttagtttggaggtcagccttcaaggactagtcttgagctaattgaatttctaagcacaggcatatagatgtggtttgaatactcaaatacctcaggtggcaggcagatacatgagggagggaagcaggccaatgtgagatggagtaagacgtggagtaggctgtggaaaattggaacgttcctggccctgctagaaggggcaactaattctccagagaaaaataattactagagacctaaactaggtatattaaacaaaatacagctgtgaactgctaattgacaactatttagattaattttattagaggctcagagatagagagctacatctgcttttgactttgctgctatttgaacaggtcacttccaccttgcaggttcttagattcttcatatgtcaaatgaaaaaatggcccagatgcacaaaagctctagcactcttgttctttctgtcctgcagggcacttgtgttagatagtagtcctcccactgagctttggccagtaaagagcaccaataacaacagtagaataatgaccagtgttcacagagttgttgcagtgtgcaagacattggggtgggtggtttttcttctagaaaataagagcaagagaggaagacaggcaggcaagaacaagcatggtatgtgcacagacaaaaggaagccagagaaatagagctgagtttctctttggttaatgctcaataaaagtcaattgtttttttctaatgattatttaatcttgcagtaaatgggcaaaagtcattcatatgttcattaaacacatttattgaatacgtattatatgctagtgattggtaactgttaacttgtctcagaccaatacccataggcagaccttccaaaaagaggattggcctctgtgttttctgttgctataatagaataccaaaaactgggtaatttaaaaacaatggatttttttttttggctcatgattctggagactgggaagttcaagatcaaggggttgcatctggtgaggcccttcttgctgcatcatatcatgttggaagagcaaagagaggatgagaggccaaggggaaccaaatgcatccttttataaggagcctgcttcagcagtaactaacccactcctgtaataactaatctactccagcaataactaacccaactaacccactgcagcaacaactaactgactcctgcaataatggtattaatccatttatgagagcggagccctcatacctaatcaccacttaaaagtctgacctctcaacattgaggctttggggattaagtttccaacatgtaaaatttggggaacacattcaaatcacagcagctgccagtactctgtagaaactggccactgccgagtgctttaagaagcaatcctggggccaggtgcggtggctcacgcctgtaatcccagcactttgggaagccaaggcgggctgatcacaaggtcagaagatagagaccatcctggctaacatggctaacacggtgaaaccccgtctctactaaaaatacaaaaaattagccgggcatggtggcgggtgcctgtagtcccagctacttgggaggctgaggcaggagaatggcatgaaccctggaggcagagcttgcagtgagccgagatcacgccactgcactccagcctgggcgacagagagagactctgttaaaaaaaaaaaaaaaaaaaaaaaaaaaagcaatcctgctgcattccaagtcttggatagcaacccttgctgccactgccaccaccattgccacccattatgccaggtaagagatggtttcttcttcaagcaggaactatgaagtgacaaattcggtctcaagcttttcttattatagatccacaactgtaaggcttgaaattaagcttccagatcagggaaggagctataaaccctgagccagttttagggattggcactgagactccaacttaccatattgctactgtattctggccccaggttatgccaggggaggggtgagtgcttccctaactatttggctttaaatgaaaaaactaatttttttttctctctccattttcacacgtttctcagcacaacacttctgatatcacatgtgtgttttgcagggggcttggggagcaggttcccacacaccaggtagttatccagtagacaccaactatgtgtcctataactcaattctgacattttctactgggagatatcatcagattccacagattatgggctcagtcccacaagactgtcccccacttcagatgccaatagcaagtactaggttgtcacctaaacttctgattgaccagctataaatcaggggttctcatgacaccctccttcggttcatttaatttgttgggatggcttagtgaactcagggaaacactttacttgggtttactggcttataattaatgacagagtaaaggatatagatatgaatagccagattgaggggatatatagggcaaagtatatgggaaggggcctggagcttccatacccactctggataagctgctctccaggaacttccacatgctcagctttctgtaagctccctgttcttttgggtttcatggagactttgttaagtaggcatgattgatcaaaccactggctattggtgatcaactcaactttcaatcctttcccctccccagatgtcagggtttggggctgaaaattccaaccccttaataaacatggttggtttccctagcaaccaaccccaatcctgaggctatccaggagccaaccgagagtcacctcatcagaacaaaagatgctcctataacccagaaaattctaagggatttaggggctctgtgttagatgcttcctatcactctgaaaattacaaaggtggtcttaggatctctgcatcaggaactggggtcaaagacccaataccagaacaaaagattctcctggtatctctatatatgaaggtcttaggagctgtgtctttggaactgggtcaggaatcaaatacatatttcttactatatcacaagaccacagcagcttaaaagccacatagcctgtaagtcagggtcctcctaccggggtctgagctctaaattgctgtggctctgagtgctgctccagaatgcaatgggcaatgagtatctacgtacctgtttctgctcccctgtccatgaattttccccagtgaacactgctcaagccagccttgtgtatctgacgttgaccatcttgcttgcatgactgccaggagctggaaccgcaacagagaacaagtcaaagtccctgcccacctgaggtttacattccagtggagagactgaaaatacacaagtgagcaaagaaacatgcagcagactgcaggtgattgtagggtatgagagagactgatgaaggctgggaggaagaggctttctaaataccatggccaggagagacctccttgctgagggggtaaatgagagcagaatgcatttagggatgcaagccacaggcactatggaggaagaggaataccggaggaggggaacagtgcctgcagatatgtgagaggctatctgtgtgcagcatatgatgtgtggtttccaactggaaatgaggactgtgggttatttcttcatttctcaaatactttgaacaattattgtgtgcaaggtgctggaaacacagctatgataacccacaggccctgccctcaaggaggttaccctctaggtaggagttgatgtatatgtggggagtagaggagtgaggtaaagaactgaagaggcaatgacactgcaaagtgaccagtgctgagatgggatagagaggattgtgggaacaggggatagcagggaggagccactgaggaggcgggagctgccagacagcttaatttatctcgctcatgatcagtatagcttcaacaaacagcaatgtttttactgtttatttttagtttatcataaagctaaacatgttttttttaagttcatgtccatcctacatttgaggctttcagttagcctttatttttagattaagatgttatagttgatggttctagtacctttcatatgcaaaacaaaatgctcaatatgagagggagggaactttttaattttgtgagactgaaatttgaatatccaagagccactgctccagccaaatgtcctgccaattctgtccttatcaaaggaagcttatatttattgagcacttactacatacaagacacttgtctaagtacttccatgtgctttgtggatcttcaagctaaccctgtgaagaagggtagattatcatccccattttatagatgaggaaaatgaggcacagagaggtaaggaaacttgcccgtggttatgcaactagtaagtgtcagagctgggatttgatagggaaattccagaactcatgttcttatcttcctcttccccacaaaaaaaacaaccagcaacttttggaatattagaagtcaaagctttgattatcatctatagctctttttctttctcccctccccagtactggctttggaaactcttggataaaaattaccctagaaccgaagagaagaaggaacccatagataggcaaagattcttggacattcccctgagaaataaaaatgctttgccagcgagctcactgtgcatatttgctgctccacggatgcgtcccagttgggccaacttctgttcttggctgtttgaatatatcctggcagctcagaggtgtaatttctccaaatgccgcattcctgctgagcccatgggatgaattgtgcaatttcgggtgagcacttttttaaactctagcagtgcttgtagtttccttcctcctactttctctgcaggctccacatggaagattgagggctgagtggttgctggggccaggggtacagaaggtggagtgctgggatgaagagacggagaaaggcaggagagggagaggagggtggcagcatcagctgcccaggcaaatgccagagccccactttgagaattgagatcatctttaatttcctggagtgttcattcattcatgcatccacttgtaaaaatatttttgcattatttgctttatgccagatacaatttgggagtgggaaacagaaatacagggacaggtggaatctcagctgttaggaaggcaagtctatcttatgatgagcatacataatgggggacagggttaaaacaatcaaggagaccagggacatcttcttggggggcacactgaattgagcagaagtatgaaggcagaaaggggttaattcagtacagaggagaggaaagagtgtccgaggccgggggcggggaggcgggcagcctatgaaaagtttctgggacaggcaggagggtacctgaatatatgaagaattcaaaagcaaccaatctcctccccactccatttatgagtgctgactgtgtgctggcccaggctttggactttataacatcatgataaagcttgccgggatttcagattttcaaacaaacaaacaaaaaaacattttaagaagctaaataatttttccacagccacataagtaatgcatagtggcatggaaattcaagtccaggtttgtgtgattccaaagaagggcttcttgaccaccactttatattgttttcctagaaatctctcatcatttgcagagacctatgtaccctatgcatacttctgtcctggttctaacattgaaaatgtgagtagattgatttcctatagaataaatagaaagtaaagataaaaaataaagtcacaatatctaaaactgtggaagtgatgcagttgtccattgaggaataattggataaattgtggtgtacacatacaatggaatattattctgccttaaaaaaaattctgacacaggctacaacatggatgaactttgaggacattatgctgagtgtaataaaccagtcacagaaaagatagtttatgattccctttatatgataaatctagaatagacaaattcattaaaagcaggtggtttccagggcttgcagggaggtgaagacagggagttatctaatgggtttagagttttagttttgcaagatgaaaggagttctggagattgggagcacaataatgtgaaagtgctgtcacaaactacataatagtgttgcagtcagcaacgaactgcatatacaaaggtgatctcataagactataataccatataccttttctatatttagatatgccgagatacacaaatgccgttgtgttacagttgcctacagtattcagtatagcaacatgctgtagaggtttgtagcctaggagcagtagaccatcccatctagcataggtgtgttgtaggctataccatctagacttgtgtaagtgcactctgatgttcccacaatgatgatatcccataacaacacatttctcagaatatattcccatgttatgacacatgactggacttaagattgctgaactctgcatttcaaaatggttaatacgatgggccaggtgcagtggctcacacttgtaatcccagcactttgggaagtcgaggcaggtggatcacttgaagccaggagttcgagaccagcctggccaaaacatggtgaaaccgtatctctgctaaaaatacaaaaattagctgggcatagtggcacacgcctgtagtcccagctactcaggaggctgaggcaggaaaatcacttgaacccagggagtggaggtttcagtgagccaagatcgtgccactgaactccagcctgggtgacagagtgagaccctgtctccaaaaaaacaaaaacaaaaacaagctaatatgctgcgtgtcatgtgtattttgtaagtaaaaatgtttaaggaaaaaaaggaagaaaagaaattttttaatcatgcataatttcatctggaaataaccactgtttaaaaaatcagcatgtaaaaacttttagacatgttctatgtaaatgacacatgggaatctttatatgtttgcacataatcggatcacatgatacatacttcggtagcccatttattttcccttagtatgtcagaaacttatttctaggtgagtaaatacacattcacattattattaaagacaatatagtagttcccatcaatcaatatccaggacgtgcaccatggttcacaattataaacatcatcataatcaacacacttaggctcagtaccctcatctgattattaccttgggatgcagccccaaattggaattgctctgttgatttttgcatttgtgagccccttaatactcccatcaaatggccctttttaaaaagttgtaccacattatattatttctaagagttgtccttctgcctggacctttacccttttgtgtttgatgtcagctttacaatgtatcagtggtatgatcttgggcaaaggggcctcatttgtcccagatgaatatggtgcctattccacaggctgaggaaggagtaaatgatggaatcctcatacagggctgacagcatacagcaggtgctcagtatgccttcactatgctgtcattaccttctcctcattctccaggaataagagctcctcaagagcaggaataccacacccagctctggtgcagcctggtatctgttgaaccagtgtgagcagatcagaacagagcgagtgatgtgtgagtgtttgtagaaagccttagaaagagaactaagagaaaagcttatttcctggatccaagggaaatggaaataagcagcatactgtgaggacaaatggacacctctgcctttcttgcttttacttccaggtgtgtaagcctttcagtcctgcttttaaataatttttcatttgcaacaaaaggttcctggctgggcaggctggcaagcatccccaagcgggcacagagggttcattattcccaactcccttatggagccagccagcctgtgtcactgcaatagtgggacttttctgatcaatctgaaataaggagcaggcccagcatggccattcatgggcaaacccttttcctctgataatgaaagtcaggatctgagcagacctgcagtgtgagtccatctgggaaaggcagctggtggggttcacgaggatccagccagctcttctaaggggctttcgccagatgctctgaggatcacgctgcaggtggggttggggatgtgtggtgccttttagtcatctctctctctcgaaagatatttgatttcatggagcttcttttcatccagaaatcatcctgagttactgactctgagatacagacttggcaatggcagtcagaaagggactcatctgtgctcatttaatgggattttttgttctacagagatccagaaacttccagaggcagcgatggtaggaggcaggttagggcttgaagaatttgggaggtcagtacttttcagaagttctaacatttgatgaatggggatactgaggtccagagagaaggagcttggtgaaggacagatgataatcagcctggattttaagtctctccctccctcccttctttccttccctcctttcctttctaactagcattttggctctctttgcatgtcaggcattgtgccagatgctttcctccattagtccttccaaccacctgtgcagtaggttttattattagttccctttcacagatgaggaatgtgaggcgcagagaagcaaaattacatgcccaagatctcacaactaatacactgtaaaatcatttcctttctctccctagaggttctatagccttgatggcaggggagcaggttcttattctcatgaagaatcctgaggaaacaatcctctacaagaaagcaaagtcagcagccagtcagcctgggcacagcagtgccaagctcaggtcaggaggtcctgcttcatgggcatcagccagccgtgggcagaccagcttggctacatagcacagtcctccttgcagccccagcaggagtctaacatataattattgaagggctcatgggaacccacagagcagggagcagagcatgggattgagaccagggtctctggaatcaaatcaaatcccagctgagccactctggagcaatatcttggcatatgttttataatatctctgaatttcattttctttatctcccaaggagaatcataacagaacttagctcataggttcatgagagaatttaaataaagtgatcagtacaaaataacacgcatggtggacctagaaaggattctacaaggccgagcgcagtggctcacgcctgtaatcccagcactttgggaggccgaggcgggtggatcatggggtcaagaaagcgagaccatcctagctaacacggtgaaaccccatctctaccaaaaatgacaaaaaattagccaggtgtggtggtgggcacctgtagtcccagctactcaggaggctgaggcaggagaatggtgtgaacctgggaggcggagcttgcagtcagccgagatcatgccactgtactccagcctgggggacagagcgagactccatctcaaaaaaaaaaaaaaaaaaaaaaaaaaaaaaaaaaaaaaggattctacaaatagtagaatccttctaatagtatcatcattatcatcatcatcatcaacaacaacatcatcaccatgacatcataaaagaccatgtggcaatgagcctttgatatattattaccattaggaaatcatagcaggctaggatgacatctctgcaatgttggtggcctttattggtggcagacccttgtagcaacagagaagacctcacaggaaatttgtcttacatacttatttatccttttcagctagaacaatttctgagtcattgtagctacttattaaatattttctgattaattggatgaatgagcaaataaataaatgaaagaattaactactctctggcctggttcaaaggtcattttgctctagcaaatactcttggatcaggagatggaaatgacaaactactcaagaacaacctgagatttacatctgcaaacccaaatactcaaataatatgaatacttaataaatggtaatcattgcaatttgttgcaagctatgcctatgtattgatggtgtactaagcacttaatgtgaattatctcacgatactcaacacctttgaggtaggcattattattatccccattttacagatggggaaaataaggtttggtgagggtaagcagcagttcaagatgatgcagccaaagtagcagcagatcctggattggttcctgggtctgtctgattccagggcctgtgctttaaagcactaccctctttaacctcccccggtcttcactgagggtcaaatgaaaccctaaactcagcttccctcttttcagagcagaaggatagattttgggaaagataaccatgtaatattgggtatccatggacaaatggagggtcagacaaagataacttttcagtcctctagcatctatagtacctcctccctggccaattacaggccacccctggcatgcccagaacaccactacctttgctgcctgtaccagctcacttatcaatgtttgttcagtgtcccatttcctccaatttcctctgtactctagttctccctagcaaccagtttgagctaagacatcaaaagtgtgttttccagacaattcctccaatctctggtgctcattgtgagaaggaagaccagacctgaggcccagggctcccatcttcccaccccgacttttaacggaagagctcagcctctaactgaccttggtctaccagtctggttcctgcactagatttgaacaaagggtttttgtgaagcaaacaaacaagtaaataaataaacttaactactggcttaatgtaatccacaacttagtcattgaaaaatactttttgggccgggcacggtggctcacgcctgtaatcccagcactttgggaggccgaggcgggcagatcacgaggtcaggagaacgggaccgtcctggctaacacggtgaaaccctgtctctactaaaaaatacaaaaagttaactgggcatggtggcgggtgcctgtagtcccagctacttgggaagctgaggcaggagaagggcataacctgggaggtggagcttgcagtgagccaagatcgcgccactgcactctagcctgggcgacagagtgagactccatctcaaaaaaaaaaaaaaaaagaaaaaagaaaaatactttttggtgcctgctctatgcttattctcaatatcagggatttcaaggcaaggaaagtccttgccttcatggctgttatattcaagtggagagacaggaattaaactaacaagttgacatagagataaatgagaacaataatggtatgtgttaaagagagctaaaagcaggcaatatgtcctgcatggtaaagctgaatgatgatctccaaaaggatatctaagtcctgacccctggaatctgtgcatattaccttatatggcaacaagatgtaattaagaatcttggaggaaggagattatcccagattgtactggcggccctaaatgcaatcacatgcatcctttcaagacgggcagatctgggagctcacattggcaagatggctaactagagttgcctggcattcgtcccccccacagaaagggaccaaaacaataaataaacaactatagtttgactacagtgactgaggaagtatgttggagagccctaaaggagtggcaaaatcctagtggagcacggacgcccaaaatagcaccataaaagaaggagaaaatcatcttgcatctaccacattgtctcccctgctgggatcagcatggagacatggtggatttcttcttccagggaaaagataagctggagacctatagcagttcctatagccactacagatgccagtggtctttgctataggagcatcccgcagtcttcacgggctctgaatccaattaagaaagttgctaggagttcatgcagctgcattgccccagagtaggagcccaggtcatgcatcaccccctaccaatcctatgacctaagctgctacagcatggtgccatcttgaaaccagacccactgctacaatgtgtcctgacctgggggccagtaccactgctctctccattcttgaggctctgccatcatttcatcatattcacaccagtgcctacatcaccatgatcctggttatgtgaagcctaggcccagtggaatgaccaagatcctggtgtccaaactgatgtagcataattcccaccagaaaactggcagatctgcacagtggggaagccactgaacagcgggccatcctaccctgctcatgtgttcctgtgccaagcctgacagccatctcagtggtgatcccacctccccagagacattgctgcacagccagcctgcctgccatgcctgaacatgcctgacttgaaaaccaaaccagtgcccttgccctcagtaagaccatgccactgccatcacaaactcccacagcctttggcactgaggcaatcacagacattgctgatgaagattacagctgaagaaatgatgcaaagaccatgctactgagccacccagaaccaaagcccatgttccatacccaactgtcatcaagaatctgtctacagagaaaaagtctctccctacaaaactactccatctaattgtaaaaagcaagttttccacaagatgtgcagacatcaatgtagggataaaagaaacatgaaaaagcaaggaaacatgccacctccaaaggaacacaataaatctccagtagcagactccagagaaaatatttgcaaaatgcttcataagaaactcaatgatcttaagaaaaatcaatgagatacaaaagaatgtagataaattcaatgaaataaaaattatgatctgaatgagaaatgcaacaaagagatattataagaaagaaccaaacagaaatcttggagctgaagaattcagtgaatgaaataaaaaatacaattgagaacttcgacaaaagactagatccatcagaagaaagactttctgaacttaaagacaggtcttttgaagcaaactagttagagtggaataaggaaataagaataaaaaaataaagtatacaggacttgtgggacactatcaagcaaacaaatacttacattataagggtgtcagagggagatgggatcaagaaaagcgaaaaccctatttaacaaaataatagctgaaaatttaccagtcttgagagagacatgaacatccagatccagcaggatcagaagtcctcaattagattcagttaaaaaaaaactctctgaggcatattataattaatttatcaaaagtcaaagagagaattctaaaagctacaaaaggaaagcatcaagccacacacaagggaatccctattagattaacagcagctttttcagcagaaactttgcagcccaggagagaataggatgatatattcaaaatgctgaaagagtgtggcactgctgacactttgggatctcatttctggtctctagaattgtgaaagaataaatttctttgtttaagccacccatcttgtggtaatttgttatagcagcaccagaaaactaatacatatggctactttagactaaacggtcaggaaaacgttctcagatgcagtaatgctgaagctgatgcatgaatgataagagggaacctccttatgaagatccaggggaagaatactgcaggcagaggggacagacagtgcaaagaccctgaagcaggaacaaacttggcttgtctaagaaggaaaattagtgtggtaagaatataatgttgaaaggaagagacttatatgggaggttgaagtcaaaggtacaggaaagaaaaatacataaaatttcaaaaagccagggcaaggagtttagattttattctaagtgtgaaggggttccattgcaggatttatagaaggggttgatgtgtacactgtacatttttttttttttttttgagacaaagtctcactctgtcgcccaggctggagtgcagtggcgcaatcttggctcactgcaacttccgcctcctggattcaagtgactctcctgcctcagcctcctgagtagctgggactacaggctcctgctaccacacccagctaatttttgtatttttagtagggacggggtttcatcatgttgatcaggctgatctcgaactcctgacctcgtgatccgcccaccttggcctcccaaagcgctgagattacaggcatgagccaccacgcccagcctacactttacatttttaaaagtttactctggcagctgtatggagtttggaatcagaggggcaagaattccagtagggaggtcagttaggatgttattatagggtccaggtagaagatgttcctgatttgcactaatgtagtggttgaagagaaagagaagagacagtagatggatttgtaatagatcatggagtaaactaaatgggaattgtttctggatttgatgtggttgtgtgggtaagtgaaagaaaatttggcttgaaccactggaaagataatagtgcttttcactgaaatgaggaaggcataagttgggaaagaaaaccaagaaggcttttcttacattaagattgagatatatatagacttccaaatctgggcttaaggagtaaatctagatttggagacacagaatatgagagctattgacatagatatttaaagtacaggacttggtgagatccctggggggatgggaggaatttatatagagaggcaaaaggagcccaaagcttcatcctgaggtaccaacactgcaaaaaggaagaaccagcaggggaatatgagacagacagtgagaggaaaatattgcaaatgtgatgtctcagaagccaagagaaggaaggatgcctaaagagggagtcattaaccatatcaaaataagttcttcttgccaggtaacttatgtgcattttcactgggcagtcagtgtcttagctcttggccaacaggtttcttctcaactgccatctcatatcattggcagtggccccctagagtactctgatgaaaaggatccctgtgccttgcctgagcttggcaggaaagccagctgtgatcagctggtgatggctgtgtgaaaagttgggcaagagttctttgtgttttatgatcctgcataacccaatggaaagacatgagttacggtcatttcaggggcttttgtagtttacaaggagctaaactgtggctagggcagcccatcaaatcaatccccagagccaaatccatcttcatgtaaggcctaccctgtagtggatacgagattagttgtaggactgcttaaggaagaagtagatataaagagacagagacaaaatgtaggggctataatttaaacaccaaaaagccatcaaggttttgaagtctaacatctagattcaactctcaactctaccacttactatgaggatgtgggtaagttcatccaactgtccttagtctcttttctttacatgctgagtgatactaatggaattgtgaagcaataaaaacatatgaggctaagactcctgggaactctaaagatctatttcttgagggttcaggataactcttggaatctgtttcttgagggtccagggtgacacctttaatttagttttctatgacatagaagtctatacctctaaggctatagcatcctctttatagagtgtctgacccatgataagttattaataaatgatcaaataaacttggagaacaatgatactgattttgtgctattgagacactgtataatcagatttggttagatggcaatcccttattaaagttttaaccagttacaacaacaaaatatatgtaactatttttccatgctcccagcttttgaggagaataccatgtggtcacagctcagctactggatctctgttggacagatcagggtaatgagtaggaaggctgagttgaagaaggtaagggaaggaaaagtagattcctctgcacaactaagcatgtgagtcaatcgacttggggataaaattatttaggaaggtggaggaagagattaaagagaagaagaaagtgaaagatgtgataagtatgggctgaactccttgaagataggagagagaattgaataagtaccatgaagaaagggaccttgggaaaagggagatgtgtctataaagctctttaaggaaattgccatttttgggttgttttggtttttgggttttttttttttttttttttttttttttttggtgacagggtcttgctctatcacccaggccggagtgcagtggcatgatcataactcactgtagcctcaaactccagggcccaagccatcctcccacctcagcctctggagtagctgagactaccatgtggtggtgcacacaccaccatgcccagctaattattattattattattattatcattattgtagagatagggtcttgctttgttgcccaagctgatcttgaactcctgacctcaagccgtcttcccaccttggcctcccaaagtgttggggttacaggcatgagccagggcgcctattcgtacattgctattcaagacactttggagagtgtacatgtggttgaatagctttatgcttaggctagcctcaaggtggccctgttttatttgggttacactggcaacaaagcgccttcatactcatcttctaatttgacctcatgttaacacatctgtgataaaaccttatcagatttttaaattattatccatccaaaaaaaggagagtcttgacctgtgttactgaggttaacaatgagcagagctgtaagtaaaatctaagtcttctgactctcagactagtgtgttttctcttccttccctccgtcactccctcccattctttcttcccttctctctttccctttctcttgctcctcctgctctctcaccaccctattctctttctcaatatattgatgttagcaatgaaccacaagcataagacattcctgaaccgacttcaagattttagttgaaaagtttttagtcccaaagagtccaaagcagtgtctgccaggaaacaagaaggcctgtgtgtggtgttcaaaaatgtgaagaccccagaggacttacattttcagcttttagagcaaaggctcatgagtagcagcccgtatggtggtatatggatctcggcactttgcctcccgcatgccaaagatccagactgcatagggatttgagaactcgcctgggcaaagcagagtttttaataactaggagacaggatgccgtctgacaggtttctgtgctgccgcttcacgttggatcacacacacaagcgtgagtgagtggccagctgaagtcccgtagggctgcattcctacttgcttcctccttccttgggctgctgaaagaacccatttgtgtacagtttggctaagaaaaatcctgttgctttccaagtgatgctttgtttgtttctgttacaaaacatctgaaaaatcagcatttcccactcagcatcgagccaaaattgactgctgtctctatataataaagcggcatattttgcctctatcttctaattggaagacagaaagtctcaacaaacagaacatgtttattgattcagcttcatcccagaaactggacggcaccacagggaacgagcagagagaaagacagagcgggctgacttcaaatactttgcaaatgctccttagcagtattaatgagcaggagaccgtgtggtatgttacaacctcatgtgatggagtaaatgaaggcagggcatactgttttgtaatgaagtgaagattcagtggtaagtggaagtgctcatttcctgagttgctcatcgtcttctctcgctgatctggaaatatacgcgttcccaaaatgcagagataataaggctcttatgaatgcaggaacaagtcttgtgcacttgcaggggaaaacagaaattcttcaatgcagtctcaaaagaagcagtagagaggtagaatttaaggtggcacagctgggcagaaggcaagaagagacttgctcttggcccttggcatgggtctgaatcacctctacttttccttatctcatcctgctccctactctcctcaacctctctgctcattgtagcaaaaaaggcctgcaattggatgggcctggtctgcagggtccctctgtggtcccttgatcatttcgcagcccagaaggagcttgcagaggttcaggaatgtgctgctaatgaatacacagagccaaccctttggcagaacctactgctgtcttgtctggcaacctgtggaaagcggagggcacacctgctgcttgcttggatcctggccttgggggcctgcagctccccttgcctgttacagatgcttttttatttgctctgcctgacaccaacaatttgtaattcttgcacacaaaccccccacggtaggtcagggggctcctccagctgcagtgcaatcactgccagatctgatcctcactctcacccagaacacaggcaaccttgatcgaccctgaacttcagagccatcagcaaggggcttcttttcctttcggaagctatctgtggttcctaacaacaatggggagagccaagaatccatggaaatttgagagaaagagaaagagtaaaaacagcatgaggcatggaaaactttgattctggcagatctaggctccaatcccaattctgctacttgctagaggcaccgtgggcaagtccacttaacctgccttagcctcgggtcctcagtcctaaaatggggatgatcatgattcataacattgaaggaaagcttaactcatacagcccataaaaagcctttggggacagaaccggacatagatagaccacatgttgacatctgttccttccattcacccctcaccaccagtttttgatcactgagcacttactaggcattctataaatgtctgaagaatgaaaaaaatgatttgcatgaatcaatgaatatgtaatttaaggtcacagaaatgaggctaactgttgtaatggatttagcactgaactaaaagttagatgatctggttttgaattctgttatttagctgaaggaactgcagaggatgtttaattgtgaaaatatttgcttagctctgttttgtcttatttttttctcatgatgtttttcattagagaaaaatatatataacaaaatttcccattttaatttttttttttttttgagatggagtctcgctgtgtagccaggctggagtgcagtggcacaatctcggatcactgcagcctccacttcccaggttcaaacaattctcctgcctcagcctcctgagtacctggggctacaggtgcatgccaccatgcccagctaatttttatattttcagtagagacggggtttcactatattggctaggatggtcttgatctcttcactttgtgatccacccacctctgcctcccaaaatgctgagattacaggtgtgagccaccacacacagcccattttaatcatttttaagcatacaattcagtggtattaggtacattcacaatgttgtactaccatcagcactttctatttccaaaactttctcatccacccaaacagaatctctgaatccattaagcaataactcaccatttcttcctctccgctgtccctgataacctctattttattttatgtctctattaatttaccattctagatatttcttataaatatctaggagtcatctaatatttgttcttttgtgtctagtgtatttcacttagcataatgttttcaaggttcatccttgttttagcatgtttcaaaactttgtttctttttacacctgaataatattccatcgtatagacatgccacattttgtttatccactcatctgttgatggacacttgggttgttttcaccttttggcaattgtgtataatgctgcaatgcacattggcatacaaatatctgagtccctacttttagttattttgaatatatacccagtaataaaatgtctgtttcataatgtaattctttgtttagctttttgaagaatcatcaaactcttttccacagtggctgcactattttacattcccaccagtaatgtacagtggttccaatttttccacattctagtcaacatctcttaatttttttttaattttagccacccctagtaggtgtaaagtggtatctcattggagttttgatttgcatttccctaatgagtaataatgatgttatactatctggtgtgtttattggccatatgtctgtgttctttgaggaaatacctgtacaagtcttttgcccattttttagttagattgtcttcttattgttgagttacaggagttctttatctattcgggatgttaaactcttaagcaggcattagacatatgttctaatttagtttccaattgcacatatttttttccattctataggttgtcttttcactttatttagctttatttttaattaaaagttacaaacatacatagataagcatgacttaaagttatgaatgtgattccttagttcaagtgccagaatcagctttgtaactatttatctgtaccctccagtgtaatgtctaccccttggcattaaagggcaggaaacttgtcagcaaaagaagtgtgtgacttgatagaatcttatttctgtactccactagcttccagggagcaagaggtattgctcttgcaaatattttgttatactaagtattaacctaaactgattagatccagcattaaactcaccacagcgccatgcaatgtcttccaaggtctgccttattcccttggttcagcagtggaaggagagagtaaagcgacccaattacatagatttctaacatggctgaagaccaaataaccagacagcagggaggatatcccgaccccaaaatatggcctatatttggacagagcttcatgtttacttgaatacacgcttcagaatcccaagggagcatctcttaaaatttgtataatctctgagttaactatcaagcaggaattctcccctcctcactttgataagaggcaatgggctcagccccctctgggaaatttttagggaagaatagggagactcagaagcctagaagggggagaaaaaggacattggaacagttttttccttgccagtacccctcatccccactcttaacccctttgtacctagagaagaaatggtcagaaatgggaggaaaagaaaaacaaggaattttttaaaagtcaactttatccattttaagatgatgtagtcttaccaccaaagtagaaagcatccgcacttctgaatatcatcagatcagcaggcatgagaaacaaagctgaggctttgaggtccccagtgacagccctggccaaaggaaggggtgagggcccctgctctaacatgcagcagagaaaaacaccataactcaccacgtttttagcccaggcaggggcttcggggtgcaaaggaaaagacaaactcttctcaccagggagcttcatagaaacaggccaagggcagttagatgttccaaggtccaaaaggcaagttcaagaatgtttctgttaagtgctgaaaaggaggctcggcctagcatgagactctgggccagctgctttgaggtgtctatagctggaggaagcttcctaccagaaaaggccagaggccacttgcatagaaaaatatttatttcttatctgcagaaacaaaagaagaaatttaagcaccggtctgagagtccagctggtggtctactggtaccaaaaaaaaaaaaaaaaaaaaaaaaaaagaaaggagagagatagaagaggaaggagaatgagtgagatggtgatggaagagaggcattggcttccagcactctagccaatgggatgccagtctctttgccaaaatgtgatgccaggggctgcctacatgataggttctgagtgccagatgacagcagaagtagcatgctctaatttttgtttgtttgtttgtttgttacccctctaccttgccagatgcccatgaagggagctctcccttagccaataaacaaccaagactaatagaatatctttggcaaaggtggttggcagaagtcactgccatctcaagcatcagactctaagcagggacccagtttccttgttatacaagcaaaatgttggcaggccacatggtgaaaaaagacttgggaaaaacatatacttcttgagggaaaaaaagtccctagttgagccatattgtttatgttcggaagaatctttctgtttgaatttggtttccaattggaaaacatccgagatattgatctttctaccagaaaaatagggataatgagaactgctccatgcacacaagtaacttgccaaggaccagggaaagacacagtcactctgttcatgtctgattgatcttcctctgacattggcatcagggtcagagggtgggcagagtgtgtaaagatgtctgaagtcatttattctccaggcactgtgtcagcagcaagtctttcgtgtctttcgagccctgatgagggcatggctcccttagccaagtcagtacatcctcttcccagtgaagagcaacactttcctgtatggcacctagaattagccgtgaggcaacataggactgtgattagtggtccaggctctgaagacaaacttctgcggtgtcttgagttccttgtgtcttggcagtgtagcctggttgtcaatagtggaggctcagagctagagtatctgggtttgaatccttcatttactggctgtgtgagcatagacaaaattgaaatcctcactctagatgacatgtttcttctctgaaagaaaaaaaaaagcataatagtacctgccttgaagggtagttggaagcctcagatgagctactccagggaaagtgctgggactggcattctggctgcccgtcttcttcccagccttgccttgctgggagacttgacctgtccccctgcactctggccactcctactttccttcagattttgcaacaggctgggatttctcctgctcaaggacctttcctggggctgttcccttccccaaccctcaactccacctttgccttcagctcttagctcccctgtcatctgcagggaggtttttcatgccccctaaaacaggaccaggaatcccctagtaccatgcatttccctttatgccttttattaccatcttaatattttaatttgtcgatgggttagcacatactagatgttaaaatgtaaactcgcttcatacctttatatcttcagcatttagtaaattatacgtattagggttttgtggactgaacaaacaaatgaataactaaatggagaagtgcaccatgcctttgagctgactgtcatttcatgggccttctgctttcctgcctaagaatgagaattatatcatcataaacctaagctttagcctgctctgaatttttgcaaagacaagtgttaataatgatgttgctttagcattaggaacaaggcactattaacaatctgagacacagagtatgcaggtgtttgtgaacctgcaagtaacaaaaggtagtctaggatttgaagaggcagtggggtggagtaactaagaatgtgggctcgtgagtcagactgcctgggctggaatcagttccagcctcactagctgtgtgatcttgggtgaaatctgtgccttgactctgtctttatttataaaacccttcatagggttattgtgaagataaaacaacattatgtatacaaaatgctttgtgtatagtaagtcatctcctccataagcactagtaattacttttaaaattcagatattatttttcagacattgtaaccaaattcttggacatagagaaaaaatcttgcttttctgaattctagtctcctttaatatgtcaggttcccaactctaagtggaaatgtaatcaacagagccatttaaatttatatgtgctcaagatatcttgactgatgttaatccaagcgtttatgatcacttaaggtgtgtttacattagccactagaaaaaatgtaaagtgcacacagtacatttgaaaaggcaggccttttttttttttttttaacagccacgcagcagagtatgcacataaaaattcaccaaggtgcatgcatgcggtgcctcaagtgcattgttgaaatgcatacgcatattttcatacagtgcatttccctccgggggttgcacaaccatgtccatataaatcataatctgcctggacatttggctaaagactgaatgtttcaaactataaaaaagtattgttttctttctgccagtatcaacagttcttcagtctattatcagcaaaattatcctccattgccccttcaccaccgtctctgttttctacagggaacatcctcatttacccatttttctaatgatcagtatgcagtccaaagagcaggctctttgccagcctctgccctcccaggaaccccgccagcactgtgcttgtttgtaagtggagactgtagggtagctggtgctgttcttgccgactaattgcaccccagaatcacctgtgccaaaagagtgcctggacggcacctgggaagactaatgttcattagagttgtgaacattccatattggcctgccattggtggtgcatgataagcaaagttttggattaattgcttcatatgccacatttatgtatggatttgatgctgtggcttgggaaggccctttgatggagaaattactcagtgtttgcaaatcatttactcaaaaaatatgtaccatgtgtcaactatgtccagggacttttctaggctctgattatacagtaatgaccaagtctgatttctgctctcaaggtgcttacactctgaagggggctgggaataataaataactgaaataaataagccaacagataatttcaagttgcatgctaagcattcaaacaaactggaccatgcatggagaatgactaaggctaggagtaactacattgggtgatgagccccatttggcaggaagaagccagtaatagaagaatctggaggaagagggttccaagcagaagagcaagttcaaacgccctgaagacaaaagtcaacttggccctgtgagagaaaccaggaagctaccatagtggctaatgtgtgatgagcaggagggaggtcgctctggctcagatcatgcagaccctcactggcctcattcaagactggctttgaccataagtgtagaggtctgagtcaccgggttttgaaacttttaacagaccactctggctgctgtagtatcctgacaatggaaactcacacttagacccatttcttcatcatggatcctcttctaaaagaatgacataaaaatgtgcttcttttccccttattttggagtacttggtgccctaatattactcagtcactataaagaccctgtgcttatgctttcaaagctgctgggctttcctggcttggctttagaaatatatttgacttcctttatcatttgaaaggccccctgaaggtggtaagccctctaattccaatgggaatttgaggagttttgagcaaagtatcaagtatagaaaactgctacaagcaaagaaaagaagatctacctaaaatagatggtgcctgcaaagtcatttcttagctagttcatcctagtggttcttagtagaaaagaatcaaacaattatggaattgtaataggatggaccctgatttttctctttggggcctggggagaattggccaagaagattaagcttctaaaaacttttaagaacagtttcttattagtgttttcagagatgacctccagacaatggattcagatgtgtagtcaccagcaggctgtaaaagtgactacagttgccgtgcctgcccactccaccactgtgccaggcacttagcaggtgctctataaacatcaacaaagactggataaatttctactgaacacctactacattaagcactttgacaggaaatggtggcaaagtcttttgcctttgagtatttgggaaggcagaatacacccaacttctgctcaaggggtcagcagtccctgggaagtcaataaagagtcttagagaatatagttaaagaaaatagtaggagaggagtccatagtcagaacctaaggctaaaattcaggcttatggccatggagaaatgttgagtgatcacagggtctagggtgtaacttcccaggaggtgatagagagcaaatagaagaggggcttattggagatgaggatgtcagaacctgagaggcagggatgcagatagattgccacataaaaagcattgtctcggttgaagaggcagtccatgagtcagatgcccacatctctgatggatgggaaggaatgaccagaagactagtacatggcagtgacaaggtcagcatggagtgggagggtgtcatggttctgtggcacaagtctaaaaagatcacagctttctaaagcttcttttggattgatctgtttgctagtctttccactagactataatctccttgagagcaaggacatttgtcatacccactgtcatatcctccatgcctgaaatgtggtaggcattcaatacatattgctgtaatttaaaaaggacccctttcttggtatttgtgcatggaataacccttcttcatgattcacatcctcttggtcaaccctagcagtgatgtttccccattcctgtgttttcttgtgtgtgtttatccctgtaagttccactttcctcagcctttgcaattgtttatttatttattttttatctgggctccaaagcaggggcacctgggagcagggatactatcacagttgtctctgtagtccttgtgctgagccgacttacaggtattatagtagacaccaagtatctttggtaaaacataaaatgaaagatttattttaatgatatcctgcatggttctcatcttctgaatttgaaaaaaaataaactgacttaagagttttgctccaggagaaagtatggtgcacccgtactagaaaagtgcaattaacataatgggtaaaaagacatttgataagtcacaacgcactctacaagtgcacaacgttctgacttattggtgttgtccttatttagagtgtgacctgaccaaagggcatgcattgcttggctgttaagagacagggatcgtgaggctgaagcaggagaatggcgtgaacccgggaggcggagcttgcagtgagccgagattgcgccacagcactccagcctgggcgacagagcgagactccgtctcaaaaaaaaaaaaaaaaaaaaaaaaaagacagggagatctgagggagcgtataggagcaataaatgcaacgaaaagatggtggtggtagtcttgagcgggctttgatgaggacaagtagggaaagggggcaggaatgtgagtgaggactgagctatccccgctgttcattgagagtgaattgaaggatgtcctccaatagcagttgaaagccagggctcatcttgagtaaataaggtttttcaaggggctaccaagaggtgaaagagccactgagataaaatctgactggtgtcagtctcagtaagttcaactgcttgccacagagaggacatactcattcttcctctgctagagtaaactctgctatgtaaacatccaactaagtatatcaggcagccagaagtaaggccaagaaattgtgaaatacccagggtggaagggcctcttcaccctggaagcagtgtgatttcacactaaaatgactcccacacaattcccatccccattttgggactggcaggtccagttaagacagagcccaactggcttttactggctacctccaaaattgtgtacaaaagctcagcagagatcatcacaagcccattcttactcttgaaaatatgccaccttccttcatttagttaaaaaacatgccctaaacacctggtactaaccaaacattggaactatagagacacttccttgccctcaaggaggagatggggagctagagacaccaataaatctaacacagtgttatggggcagcatcatgctgtgatcacaccaaatgctgctagtgggtaaatagtgtggggtattagaatgaccactgcactctagcctgagtgacagggtaagactttgaaaaaaaaaaagttgcgagtgatcatccacaccaaatgctggtggttttgcattttgactctggacagagttaggcctgggtttcacagctcacttccacactttagctggatgatctcaggtaattcaaacacccgcttaaagcctcaggtgtgtcctctataaagtgatgctaataactgcccttgtaaggattcggtaaaataatgaatatgaaagaattagcccagtgtctagtaatagtaaatgttcactaaatctatctgcttctcttcctccccattttattacgcctattactgttcccatccctcctataatcgcttggatcactcctgttatcagtgctactacatagaggcagaaaccaagtagaggagagagattggaggataggaagagaattcctaaaaggctttgggatgaggaactagtaatttcgggtctcaaagcatgaatggagtttcactaggaagaaaggaatgtggagatcactctgggcagaataatcagtagaagcaaaggcaccacagttgggaatggcaaagaatgtctggggacagtgaggagtctaatgtggctggagtgaaagcacatgcctctgttgatgggggctcctggaagcaaacttgctcatgaaaccatgacaattgagacttctggaagccaagggaggacaatgtatcaagaaggtgcagccgggcacgatggctcatgcctataatcccagcactttgggaggctggggcaggcagattgcttaaacccgggagttagagaccagcctgggcaacatggcaaagcccatctctacaaaatatacaaaaattagcctggtgtaatggcatgcacctgtagtcccagctacttgggaggctgaaatgggaggatcaccagagcccaggaggtcaaggctgcagtgagctgtgatcatgctactggacttcagcctgagtgatagagcaagagacctcatctcaaaaaaaaaaaaaataaaaaaataaggtgcaagttgtcatccaccctaaatgctgctgctgggtaaatggtgtggggtgtcagaatgaccacagaatttaacaatgtgggaaggatcaacaataactttggcttaggtaattttgatggatgtcactttttaatttaatatagtctgaaataaatatgtaaatttgttaccttgacagtcatcgtctctttttcttttcaccccaggtacactgacatttgaaaaatatttatttgattccatattcatgcttgcattttggaatgccacagactgggcaagggcgtgacttaggcatgaatgaactggtagctagtaaacatcccctttcccttctgacaattcagaaaatcttccaaaactctaattcatttatttcatttgctaactcattcattgattcatctgtcttctcacctacccatccaaccatccacttgttttttcattcatcctatcatccaaaatgtatttatcagatatcttccctacacaatataacctcctcaaactcctgccctggcacactccacacaggcaaactttatttgaaaaaaatcaggatccctaaggtttgatactttataaaataaatatatcctcaaaaagtaacctgtgaattgattttccataaatcgaatcacatttcaaatgctccaggaaagctcgctacaggaatcctgtgacagatcttctgacaaagtagaaagtactcacataatgtaaaacatcattagtcttaaatttacttattgataaatctaaatattgggtcctcttctctctgcttaccctaggtatgccagatggctagctatgttattaaaatcaccttaggaaaaacaatttctacaagaaaaacatcattcagatggggctttgacatttatgtcatgcatttttgaatgggccggcaacactggtgttagcttcttagagcaagccaatgaaggaaacgaatatggctttcatagttttataaacctggaagccaaaggccaagagatgcaatttagttccagtggtgccaccgacagcatgaatggactcttaatcacaacctctgggtcctggcagcagccagaaccatggtggatgctgctagactgaacatttgggtatatgaaacttaactccctctgtttgtaaggacggcagtgtgtgctgctaattgtaactcaggagttcaaagtttaatactgaagaaagagactagccaaaagaaggatcaattaaaggatttttgagaaattaaagaaatttctaaaatatttattctgggctcagatgtcagaccatcacataaataaaatattaatatagtctaaagataaatgttgtattttgtgtattttagacttctcattgctgatatgtagtggaatgtaatcagaatttccatatgagaatatttagaggcaaaaactctttgctgtgcttccatggatacccacagaaaaatcatgagaaagacaaagttacatccctaggagtctttggagaatttattgtttggttaataatcacaaaatggtgttatcacttggacaataatagcacatggcttatgtatttttaaatgttaggtatcaaaatattatactccaggttttctgcccattagggatagaaagcaatccagcctggggaaggacttggcatctttaataaataattaggatgcttcacagttaagtggcccttcatggtttataaagacttagaagcatattattgtatttaacccttatagcaacctgtggttggttagttattaccattgtcatttcataaataagtctaaagcacgtggaactagataatcccctcaaggtcacagaataataagcagagagctgccaggtgaaatgtcctctttcccagtatctaaatggagctaatttctgggaggctggggaggggagaatgtcacaatgcattcttctttctttctttctttctttttttttttttttttgtaagttattgaatcttgtttggtcacccaggctggagtgccgttgtgcaatcatagcttactgcagctttgaactcctaggctcaagcaaccctcccacctcagcatccagaatagctgggactgcaggggcctaccatcaaatctagttaatttttaaattttttgtagagatggagtctcactatgttgcccaggctggttccgcactcctggcctcaagcgatcctcccacctcagcctcccaaagtgtccgaattacaggcatgagccaccatgcctgactcattctgtcttttaaaggcagtcacatgggctgcagtcctggaactccagcccaacctggaatagcacttcttctgggaactactgagatctgtttgtgttttagagggtgagcgctacttcatttagacacagaacctttccaccaaatttaaaagtcaattggaaagagcaaaactacaggactgacaaatctggaaatctgcttttgcttctctgagtattgaacctggtgattgaagccttgtctgcatcctctcttggccattacctcaactgttagttgctttacttcatttgtgctcatttactactgaagattggagtgagcagtagatgtgttttaaatgagaatagagtgaggctgggttttcatttttatttgaagtccaagccaagttgagaatagtgaaattacaattgacacagacctcttgccaactgaagcaagcacatttttcccaaatgcaaaaaggcactagctatctagaaggagcaagacagtacttcaacggcaggctcaccatgattagccacactggcctccttcctgtatcttgaatgcactaagttctttcccactcagggcctttgctctagttgttctatctttctggagcgctccacccctggaacttaaactggctccttgtcaggcaaatctggactgaaatgtcactttttctaagaaaacttcactgtccaagtaatcgaaagcagcagccagtcatatttataagtcatatcatgcttctctatgttgtcttctctttactcggatcaggtctataaaagcaaagacctggtctgtcttgttcttcactgtatccccagaacctagcttagtgccttcacatagtgggtacttaataaatatgtgttgaatgaagggaggaccttgaaagcttgggccaaacccatcctttttgattgtctgatacattaatgagctgttattatgtaacaaactgccccaaaactcagtggcttgaaacaacaatcatttctcattgttcatgcagtctgcaggttggctgaaagttgactcctctaggttgggctcagctggggtggctctgctaatcttggctgggctagctcacacatctgcagggcagctgggggttggctgatttagcctgggctcagatgatatggctccaggttcccttcatgagtctgtcatcttccttggaccagaagggtactcaggggcacgtttttctcaaagtgatggtaggggcacaagagaacaaatagaccatatgaggaccctcacggcctaagcttagaactggcccaatggtacctgtgcatgcatgccgttggctaaagcaagtcatatggccaatcccaagtcaagggacacggaagtagactctgcccatgataaggctatgtgaaaggtacagctgaagagagagttgacgaattaggtccaatatggcaacctgccacacctgaggatacaaaacagcacaaatgcataattcacaaaaggcccagaaagtgagtgttcttggtagaaaaaccagtctcctcattttcactgagatttactggtgtcaaactcattgtatgacatctttctatagatctctttcctttttctctctccctcttttactatatatgctttttcttctttcttaacattttgatatcttcccttaaatgagagggtttttttatgtttaatgatatttattatatagttttaaattccttattacaaaatttaacagatgagtgcaatagttacactaaatttagcctctttttatttaatgtagccttgcaggatttttctacaggttatttatgctttatataaaactatctcttcatctggcacaaatacatgtaccttaaataaaatccctttcttcttccatacattgaggagaacacaaattgtaagccctctcttgcgggcattttggcaatatgtggcaaaattgaaagcacatgcaccatttaactcaagtactcctattccagaaaggtatccaacatgcgtgttcatgtgttcaaaggtgttcattgcagcactgtttatattgaaaaaaaacgtctgtaaagagtttaaatatcctttaatatggtgctggttaaataaagtatggtacatatatgcagtgagagatcatgtagttatttaaaagaatgagacagctctgcagctcagatcaatcagctggagtccaggagagagatcatgtagcataagcttagcttccagggacccaagccaggggtggtatgtgtgtgtgtgtgtgtgtgtgtgtgtgtgtgtgtgtgtgtgtgtgtgtgtgtgtgtgtgtttataattttagtctacttcatcctttagctagataggaatagaaattgggcaactcacttgtcaaaacttgccaatctttagaaggtcagattaatatcaataggccttcatgaatgcatgcttgaattccatttaattacatacactctttagtatggacttggtgaagtaagaggtcattggaacaatctatccctgcctctatccaagtcacatgacaataaaaaagagtgacttcttcctgtctttaaaaaagttattcaaacacaattttaaaagaatgttttgtgactttattactgtttttgatttgggagactatgcgttacatggcaattcctgagtaccttctagatatcacacagacatctgtggtctgaacttgatgttttagaatacttttacctagaataggtttttagacatttgaagagctctattactttgcaggtttggggacagtggagaagactgacatttttaattcattatatgcatgatggcctaattcctcttcttgattgtgaactctttggggtcaagagtcaatccatcgagtactacatccagaatatattaaacactcaactgatcaaatgttaaattaagtgatccctttaaaactccaccttttatccacagttgcaagttatggctatgttctgaaaatagataggtttccccttaagaaaattggcttgagaaaaatccaaggttataaaactaattattttcaatgctgtccaaatatgttgcaaactacacataaaattttaaatattctagtagctacctaaacaggataaaaagaaactgaaaattaactttagtaatatattttaatctagtttatccaaaatatcattattcaacgtgtaatcatcataaaaaatattaatgacatattttgaaaactttttggtgcatattttattctaaaacatctcagttgggataagctgtactcaagcactctatgggcacctgtggctagtgggtaccatattggacagtgtatatgtaatagctgattgattgcatttaaaacattactcataagaagatccttctaaatcaagtattcacattactcataagaagatccttctaaatcaagtattctatcagagcattcaaaatctggctgggtatggtggctcacgcctgtaatcccagcactttggcaggccgaggcaggtggatcacctgaggtcaggagttcgagaccagcctgaccaacatggtgaaaccctgtctttactgaagatacaaaaattacctgggcatggtggcaagtgcctgtaatcccagctacttgggatgctgaggcaggagaatcgcttgaacctgggaggtggaggttgccatgaaccgagatggcaccattgcactacagcctgggcaacagagcaagactctatctcaaaaaataataaacaaattaattaattaaaataaaataaaatccaattcatgaccagacacagtggatcacacctgtaatcccagagctttgggagactaaggcaggaggattctttgagcaaggagtatgaggctgcagtgagctaggactgtgccactgccttctgcctgggcaacagagcaagaccttgtttcaaggcaaacaaatacataaagaaataaaatacaattcaagttaaaaagatgaaatttccatgctctttaggaatctgttttcacagagagaggtaaacttaaagtagagttattgtgagacagacataaaagctcatatgcagcatgcattattgctaagtcaactcacaaagaaaaatagcttaagtaaagtttagtaactacaaagcatgtgcattgaacaccttgattatggaaaaatagtgcatttaagaaaaaagtgggggcaggcacagtggcttaggcctgtaatcccagcactttgggaagctgaagaaggaggatcacttgagtttaggagttagagaccagcttaggcaacgtggcaagaccctatctctactaaaaattaaaaaaaaaaaaattagctgggtgtggtggcatgtgtctatagtctcagctactcaagaggctgggacaggaggatcacttgaactcaggagatggaggcttcaataagtggggatcgtgccactgcactccagcctgggtgacagaatgagacactgtctaaaaaaaaaaaaaaaaaaaaaaaaaaaaaaatttggagacgtgaagggagtccttaaaatctttgcagcatatggacttgagaagagtctagaaccgtgtcccctggtcctgtaatgggtagcttctctgccacatttcactcacttcaagacaaaaatgagaaacttcaagggctgttgaacacgggcaggattttcacagctgttcagagtgagttagcacaggcgttgtgggaatcatgatgcattgggaaaagtctttgctcctaacagcctcagattccacctgctcagtggatggtagtgggcagcactggtgcaggtgaaaggcagttggtgagaccattagcagcctctggggtctcatcctgcaatggactttcccttgccatggagtaccatgggaagaacttggacttggtgccaaagagccagctcctagttcctaccctgacagttcttttgctgtgagatcataagcaagccattgaaactctccatgcattatctctaaaaggagagaaatgggttacatcatccccaaggcctttgctgtttctcagattctgtgatgccaagtgaattgtgttagcgtgtgcagacatctgaaagtgtgccaggggcatccaggtattagcttgcgatagagtgaaaaagcaattaaataaaaggcaaaaaatccacaaacgcatctcagtttaggggatgatgtaggttcaggagggctcagagaaattgaaattctttctttttctgttattttaaaaatgtatattagtaatacatgaatacattctgattctggccatgcataaacatataaagcaaaccatgaaagttttccttcaacttttcctgctccaattctgttccccagaggtaatctctgtcattattttggggtacatatttccaagcccccttttctgtgcatgtataccacatatttagatattacataggtatcttatttttaacataaatggcatcatattatatatgctattctgtaacctgcttttttttcaccaataatgtatcttggagatctttatttcagtgtgtataggtccacttcattcttttgaacagacttcatagaatgaatgtaccacgattcgttcaagcgttcttctaaatgataagtatttaagctggttccagtttttcactattataatgttgctatgaatgcccgtaggatcccatttatatccacctgtgcaagtgtttccaaagataagagtccaagaaaaaggactgctgagtcaaaagccctgtccacttttaattttgacaaatactgctaaattaacttttatgaaagctccatccatttatgctctcaccaactgtatattcaaaggccataataaccaatagactactatcaatattttaagcatttttttgccaatcttgttttaatttacaatttcccaacttctagagagcttgagatctcttcaaatatttactggacttttgcattcttttctgtgcaaatctgtttaaattctcttcaatattttgaatacttcatttgtctattccttattgattcatgagaacactatatatatcctggatattaatgctgtcgtttgtcttttgaatagcttacataaatttttctcagttttatttttttaactccatgacatattttgttatatagaaatctttaatctttatatatttcttttttcagtttttgcttagaacaagattatttttcaatgatagttcccaactttcgattctataatattagaaggtaagcttatatatactgatgtatatattattttggtgtcaaaattgttttcaaagataattggacaaatatgcattattatcgatcttctctgttgatttcctatcagtgaaaatttactgttctttgcatccctttcttctaattcctctatgggacactcctgatggtttagctactctagcacagaacaagccggtgtaccgatgaaccaacctgtcagtggttaaaagaggttctcttgtttgttcctcagcagtgatggcagctcctgacctccaagcaatgagtctggttctctgacattttgttttcataggtagaaaacacaaactttcatcttgccaaagactgttttctcccttccttcctcccattcatccatcctaccgtccttctcttcctttcttttggatttttcccttccctttttgccttcttttctctctctcatgtacacatttactgagcatccacagcatgttaggagctgtcccaaatgctctggggacacaacaatgaacagagcagccaagccccgacttccatgcagctcattttccatattcgtgctgttcatttcaacagacgctgcagagctcacacttacatacaacccaggggcggtaaagggcatggatttgagaattgggagacatagatatagatcctagctcttcctcttacctgtgtgacttggtcaagttgcttcttctcttcctgagtctcagtttcctcctctataaaacagattaactgcatctaccacataagattgccataaggattgactggataaagtgtatcaagagtttaactccatgctaaaatttaataaatacaattagtaagtggcaggcactgctcatattatttccctgtatcctcacaacaatctgcagctggtggctgattgaaaatgatccactcccattttgcagataaaggaactaaggcttggtgcaatcgcagccacgagaccaggtctcccaggtcctggggagagagctgtgtttgccttttctggtttgcccagaccaaacttggagttctgttgtatctgtgcaccacctgtgcttctgtgtactcagtactttctttaagttgacttatctttaaactttaatatgagtaaataaccataatatctgtgtaaaatatgattttgaaatactggttatggtttacctcatacacatcaaaagaaatactcaactgtgaacattttagaacaggaacatgagccccacctagaaacatctcgtgtgataatgatgatctctggcctccatgtggagaaagacgtctctgaaccactcagcccttatactatataatgatgtctcaagatccacacctaaaccaaaatgccgtgactggggtggaatttcttttagctcatgaagaactgatgcttcagtcctgcagtttcagtggaagcagcctattggccatcccaactccaattttgtgaagtggcagggcaacccgagttatccagtggtccctgacatcaacaaatacaatgaagctagttcagtttaatttaaattgcagtttacacataaatatctcgaccaagtgtgaaagagagagaagccgcgtgtagactctaatagggttggcactgagaacccctggaactattggcgtcattggttgtagccaatgagtctgaaggaattagtgctggtcaggccacagtgggaatattttgtccagttctaaatagcacagtcatagggacactgctctccttaggagatgagaggggagtaatgaatgtggctaaggaaggggaggaaaaaaaaacctgtgtcctgtgaggcaggggtgtccaatcttttggcttccccaggccacattggaagaattgttttgagccacacataaagtacactaacattgatgatagctgatgagctaaaaaaaaaatggcaagaagaatctcataatgttttaagaaagtttacaaatttgtgttgggccacattcaaagctgccctggggctgcatgcagcctgtgggctgcaggttggacaagcttgctgtaaggaatgccttgaggcaatattggaaggggtcttagacctgatactctgggatgttccaggtggccggcaaggacttaattcagctctcaattagggatggttagaagcagggctcctctttcttcccacagcactctgggcttccctctatcactgtattttccatgctcgattacatctcccaaagtgcttattcatatttttcaatgactatttattgaggacctactgtgtgctattcctcatgttatgctctagaaatacagaggtaaacaggaaaaaaggagacatggtccctgtggactgtaaagaagatggtctcgtaggccttctagtatgcctcatccacagtgaatagatcactattatataacatatggtatataatttcccataatatataatatatcccataatatatagtatgttatatcccataatacatagtatattatatcctatatatcatatatgatatacaatgaagcatgtttaaaatgtcacaaagccctatatcaagatcttaaatcatattatctttcttcataataacccaaagacgtaagtaccattattaatccctgttttacagatgagaaaattgaggttcagagaaattaacctacttgctgatcacacagctagcaagcgacagaggtaggatttaaacctccttctgaagcaattgtttaataaatggattgttgaaattaaaagagcctactgtggaaaacatggactaagcagtgtatgggctaccatggaaggctgtgagcccttcacccaccctgagaagcagaggctggatgagatgtttcagacatgctagaattgtaagtcattggctagaagaattcgaagactcttcccttttcacatccctcaaatttagggttaatttccagaagatgtggccttctgctctctcagggtgctgctgctgggtatgtagaccatccctgagaaagaaacttccagggctgctgcatggcatagaatcagcccccaagaggcattttcttctaacttcagggagaagcagcagatgctggaggaaagaaaagaaatttaagcccaagagaacttgaaaggccaggattgaatttttcttttacttatcacattcaaagtcccctttctcttcctgcctctgctccaatgggcttttgagggaaggacgttctgccttttcatgcccaactggactgattagaaagctttgcaaacctggaatgcgaacgtggctgcagacagtgggaagagaaatcttttaattccccctcttgctttccccctggcagcatgacaggccctgtaagagtccttgctgaggtaatgacatggagcataattaaagaataattaaaacactggggatcattttgtcacctctgcctgttaattccctggagccgagtcggggtcctgccctgccttgtgagcgagcagcgctgcttctgagcgtgtagctggggagacaggaggtcacctgagcacacagggcctgtccagctgcacactctgcagcttcatgcaggccccgacaggcccttctggtggcctgggaggtggcagacctcagagaaagaaatgcaactccaccgggccaggctcttcaaatgaacctatcttcttattcagattaactcatttctccatccacttatgtaaaacccagttactgcgccaggtatgtgtacaaaatgagcccatcaaatatttgtttaaaaaataacaagaacaacttgtgtttccatggagaaggcttctatgctttgaaacttgatccttgacttaaatctgacttgagaccttcattcaatgcttctcctacccattccccctgccatcaccactttcagctgtgtttgagcttcctcattctttatcaaggagctatgttcctgaatacatatagcaaaaaaaaaaaaaaaaaaaaaaaaaaaaaactcaaagtgtgagctggagctgctgctgtgtgtcattgggcacattaggaaaatgtgtctctgcctttatttgcaggaagccctgtgccaagatggatggcttggcatacagaggaggtgtgggacttcagccttaacccccttttagctgacacccttgtccaggggtggccagccattgagcctgggagttgaatcatcaaaagccctgattctacaacaaatgtgtgcaagaaaactgaatgaggataaggcctgaggccccatattctccattaagaactagactgggttctcacattggtgatataagcttagagattcctacgaaggtaattcaatgcaatgtttttcaaactaggctttgaggaccctttatattgcaaagaggaatctcagaggctggtataaggatgagataggaggtcaagaacatatctttttaatcggacagctcaatctttatattcagcacgacattggactctggcatgaaattgtgtttaaaaagtgacagaggcatgggatcctgaggctagagaaatggattgaaagcaattagtctgtgcttcagatcaagggctcaagtcaacgggaatgttgtgcatgtgagttattcgtgtttggggaaggcttgtctgtccttattgcttctattgaatcaggcacagagcaggagattgttcactattgcacttgctggtcataatagtcagccctaggtttccaggtgtttctaggtgtttccagataggaaagaagggaggtttctggatgccccaagtgttttatccagcccaaggtggtcttaggattttgattttatgtagcagctggcccctcatctggtgttcatccagtggacctcgtcatgagtaagaaggaggagggtgggagggtcacactaataccatcctctgaatcagggatggactgactctactgcttgttactgctgtgtgagatgtactgcccattccagccaataaaagttaatcaacgttaactatcccaatggctggaaagtggcactccctgcatatttgcttgtcttcagatggcaagtgtcccagaacaaatggattgctgaaggcagtcaaaagtaaaggaagggtcctgggtcactcctggggtgatgaagcttcccatggagccagcagggcaactcaattgggctctgttttcatagacaattgaattgcactcccagttctgagcacccaatctaattgcctatgacatgtgactgtcttgaaagaagacctagggtctggtagggtgacctccctgcccctgctgcccctgctgagcctcaggacatccatcttagccttaatcatttagcctatgaatagtctcttggggaaaagtctgatgagagtctgggagatgaaagctgacttgtggctcaagccatgtgcctctgtacagattgtcctgtgctgaagccatcttggagcttaacccaggtgtatccagtgctatctgatttgcacctgagaaaaatcacaataatgtcttacttatttaatgattgctcaggtgtctatgacacctttagacttattttcttatgaaatcttgaatatggagaagcttattttgcatagtttgaggttatcataggccaggacaaaaacatagaaaagggagaaaaagaagggaagaagaaggcaatgagtcagcggacatgactttgtgacccctaagtatatgtttcctggtctctactataaataataataataatattagtaaactaatgtcacaactattatttattgagtgtttactgttaagatattttgcaggatgctttaaaaacattctcttgattaatctcatttattcattcaacaagctttgaatctatcacattctgactactatgctagagtctgggtttaatagtgtgtaacaatagccacagttctaccttcatgaaggtcacactcctgtgagggaaaatgatgatcaaatgattcctaaaaaaaacaagtaaaattgcaaataatgaaaaatttcttaaaaggggggacaagatagaagtggtacctcaagaggggatttcacccaatcatgagattttagaaagtttccccaaggagtataattgagctgggattcaaatgatgaaatggacgataactagagaagatggtaagcacttactggtttgtgaacacacggcttagtaagcaacagctgggtagatacagaggtactgaaaaaggcatggggtgagacacactgaatatgctgaggattcagaagagggggcatcctcttccagatggaaggactagggagttctcttgctgaaggaggcattgaaaagggccttgattgcagtaagagggagggtctgcccttgcttgaagctgaggtctggccctggacgctacagtgtgttggtgggtgagaaagtctatgtggtgacttcagggggctgtaagaacactgagtttctgagcacggcagatgtggctgtccatcaccgatagcaaggataccagagcagtcggtgcctacttggcagtcttggcacatgtcacccgaagacatctgtctgcttctgttcccatcccaaatgtcactctgctcgaggtggccttaccttctgccagggaacactgaggagggagcaggggccagcttccctttgacttcagcctagaacactgtccatattaatttaattagcatttgtgtaatcataactttataatttccaagtctaatttattttaattttatgtatgctgatttaatgatcaaaggatttgttgatacttttgttttcattcaaaacatgatgtatttatcatccatttaaacctataattcccacccctctccaaaaagacctccttggagtgtaaagagatgtggcagattgggatggttcatctcatttataatttccctgataggtttttcttttgttttgtttgtaagttatcaaagagaatccattgtcatcagggcagttgtaaaaatggatgagtttgctgtgagcttttctacctcactcagttttgaagtgagtttcagaatagatttcagatattaaggttttaggctcctaatgtagtcagagacatggaagcaggataatgtcattattaagagcacagtctttgaaatcaagcagcccaagtttaacaatggagacagggaatggtggaaaggtgggtgggtgggaggagggcgagggataaaaagttatttaatggatacaaggcacattatttgggtgatggttacactaaatcccagacttcaccactaggcaatatatccatgtaacaaaactgcacttggactccttaacccatttcccatttacaaagcgtagctcacatcagtgcacttttctccaggcaaacaataaatggattaaatttatacaaatatatatttgttccttaattgtacgaccttcggcaggttaaagaatctcagtgaatcctgtttttttttttttttcacccattgttttcttcatccatagaatgtggacaatcatgggacctaactgacttgtttggcatttgccgatgcatttgttatgccttgaatgctctagggaaagaaataaaatagaggtaaataaagattcagtcaacattcactcaacattaatgagtggctactgtctttctattcagttttatacatccttactttgcagtaaatttgtggcaggcatgaaaccagatgcaagagatactacaaataagtaggacacacacattgctctcactctcagtccagagggaagaccaatacacacacacgtagtagccacacgatgagccaagtgcagtgatggagtccaaggtttgcactgtgtcctaaaggagttcaaggaagctgtaacactgagtgggatgaggcattgaggaaggctttggggtagcatttaccccaaaatgctagagagtaggaattgctattccatatagaacagagagcaagtgcaaagattagctcagcactggtgtgcttctggaaaggaaagtgctcagaaaccttcggcctcccagatccttagcaactgccaaagggcagactgtgccaaatctgcctattggaggtgtttgctcttggcttagagagttggttcaagattccccatgacaatagatgtcacactcaattcctaaagtccttgtccttattgatttcccatccatccagaggcaagtatactcatagagatttacagtgaacaatagtgacagcctggggaagcttcccacaggagctggaccatttccaaaatgtcgcttgttccttccttcacaagatggtttttctgagacatcttggactagtctctaagagtctcatatcagtcagggtatgagcagtttatattaggtaaattaaaatattttgattctctgcatgattttaacaattacctatgtttttcttgataatcagtgtatatttattagcaggttcagtcacatcatagaattccagccttgaccagggacccagagaagtacaagtggactgttccttcctgcactgcgtgcactattcttcctctctcaggtgcttcttcacccaactcttccatccccagtgctttccttgccatgctatacggtcatccttttgatgatgccaggatcaagagattgccaacaaattctaaagaatgacaacataaagtattgttagcgatatggggtaacatgtaccctcctataatgccaatggaagtaaaattggtaaaaccccagggggaatgatttagctgtatgtatcaaatgccataatctgtaattccatgtgacaaggtagtaccacttctaggagtgtctcttaaataaaactttagctgcaagatttaaactttatcttaattttaacttaagtatttatcttaggcagggtgtggtgtctcacaccagtaatctcagcactttgggaggctgaggcaggtagatcacttgagctcaggagtttgagaccagcttgggcaacatggtgaaagcccatctctacaaaataatatacaaattatccaggtgtggtggcatgcacctgtagtcctagctgcttacaggggctgaggtggcaggattgtttgaacctgggaggtcaaggctgcagtgagccaagatcacaccactgcactccagcctgggcaacagagcaagaccctgtgtcaaaaatagatagatagatagatagatagatagatagatagatagatagatagataatttaaagatttgcatatctatttaactacagataggatctggcctcattgattataataaaaaaattaaagaagaggctcccatctgttagcatggattataaattatgatatagcaaaaaggaaaatattggcctatattactgaataattttttcattacattgaaaaaaagtgcatgtcatactggtaagtaacaaaagcaggtaataaaactctatgccaaatgtgatattattccaatttttaaaaaagaaatagaactttcttactctttataatagatttagataaaatatacagaagatatgttagtacttttttctttcttctctatgatttttgagatgtcttttttgacaagcaaatataaattttaataccagaagaaaataagatgatttcctctgaaaaaaagtgcgtgctcacctctggtcaaatttggcattgctcttcctgagtgctctagaaaccatctttatcattacttgttgtcagcacagagtcgggacttcagatacatcttcagaattctaagtggatggcctcctctggggagtgaccaggcttttccccaggaaatgtggaaataattcccttctctctactattggggaggcaggtacttagtagacccttgagaaactggacttgggagctaggagtaatggtttttattcctccatttgttctaggcatatttttcaagtctaaaagatgaccttatattctgatcattcgacatcaatttttaacatatgcatatattgtctgataactggcatgtggcttcttgagatttaaataaattattgttctgctataattcctttgcagttgcccaaatctagattttaatatcttcaacacgcaggtagaatgagaaaatctctttaaagaggcagccactgcttcttcctgctgcaattcattttgtagcccagagcttaatctaatcttccttccacatgatccattgaactttcaaaacttcagatctgaattagaaaaggaattataagaacagtcatatgttcagctcttattaggctttgttgtaatctctttatgctggaagaaagaagaggcaaggcttttcttatgtagctgttgttcctctgtaatatcctctcttgtgggttcataattaaggcaaaaacatgcattaataagcatttttctaccaatttataactcaccaggtgcttttgcactcattacctcatctgatccttataatcactgtgagtatgatatcatcattactgcctttctatagtcaaagaaattaaagcagagaaaggttatctgctcaagtatagtaacagggttcatttggttgcaaagccagaagcacaaatccaactacattaaggaaaaatgggaatttattaacttgtataactataatgtccaatgatagtaccaacttcaggcacagatggatccaggtgctccaatgatattgtcacactcaccactacctctggactctggtctgtgttggctttttccctagtagattcttcccaaatagtgtctagatggcccctatagctccaggctatgtcctaccggtttaacaaccccaaaagaaaaacatcttctatttcccaattattttacccaaattcccaagactggccattagttggtcctgtctgcttcttttgcccactgcgcctgtcactagggaatggaatgttctgattagcaggctttgggatagagtgaggtcagccctaccacatgatctgaactgagagtaggggaatggggttatttaaagtgaaacatggtgctgtttgcagaaggaaacacaaacaggagacagatgggagtgccagctctctgctgtaccaagtcaggtggctaataagcaggaggcaaggcggcaacccatttgctgatgctccccatggaatgctggaatatgacatccaaactctaggagtctttgcaggaaatccgaagaaagactagaaaccacaggttccgcagagattctcaaaccatgctctctgatccccaacgcttagcgttttgacactagactatttggattaaacattaccctcaggattaatatatacatatacacacatatatataatgacttatttacatgatcactttccaaatacatatgtatagctatgattagtaaaatataaattcattttgaaacatcactaaattcacagtgatttttggtccttatgtacatgtttaatatgtattaaaaggttattatgctctgtgcagtgttttcagaaagttttccacattaaaagggtgttcttaaacacaaattacttaggaagtcttggaatattgaaagacctccaggacaagggttcgaagcccatctctgccacgacttctagtgaccaaatctttcttggacttcagtttcctgacctgtgctatgtggatagactgtcgtgcccacaaagcttgtagtgaggttcatgtgtgggaatgtcattggaactcttaagaaatatatttttaaacttataaaatatcattgatattttattttttctttactctgggctcaaggacgttgctcttaatgtgttctataaaccactaatggcccatgatgcaaaatgtgcttgtctatttctaatataattgtgcagatcaatgaaggtctgtccttctctacgatgagcagcaggcttatagattttttttaaagatatccttcttcaagggtatatattccagaaagcatatttttatctttcttatgcctcaaatacactagagactgtagaaaatactcaaccattcaaaatttgtttaattttctactgaagtctaacatagagaaaagtacatgtattcaaaatacactttagataaatcttttaaaacttaacatactggtggccaggcgcagtggctcatgcctgtaatcccagcactttgggaggctgaggcgagcggatcacgaggtcaggagttcaagaccagcctgggcaacagggtgaaaccccgtctctactaaaaatacaaaaattagctaggtgtggtggtgtgtgcctgtaatcccagctactcaggaggtggaggcaggagaattcttcgaacccgggaggtggagggtgtggtgagccaagatcacgccactgcattccagcctgggcaacagagcaagactccgtctcaaaaaaaaaaaaacaaaaaacttaacatactggtacaaccgcacccagatcaataaagagaacattaacagttctccataagcatactttagggccccttttcagttcctaccctcacccaaagacaaccattaccctgacctctaacagcataattatgttttacctgttttttaaaaaatacacattaatgaactcatcttgtatctggtgtctctctatatatattgcatttgaaagattcatccattttgttgtgtagagtgacagattattcattgtaatttagtattccaatgtatgtgtgtacgtatatatcacaatgtatttatcctattcatgggtattcatctggggctgttccaaatagtgctactattgacattctctataggtcttcgggtgaacccatgtgtggaattctattgagtcccagagaatagaggagttcagctttagtagatactgctaaaagttttccaatgcagttgcactgatttacactccaccagtagtgtaagaaaatttctttctccatgggcttgctgatatatggtatgttctgccttttaagtttcagcccttctagtgtatttgtattgttttaatttacaatgtgcattgctttaatttgcatttccatgataaaaaatgaagttgcagcaacttttcatatgtttattggctatttggacatcctctttggtaggcacttacctgttcaagtaatttgcttatttttttgagtttctatgttcttttttttttttttgagatggagtctcacgttgttgcccaggctggagtgcagtggtgcaaccttggctcactgcaacctccaccttgcgaattcaagcgattctcctgcctcagcctcccaagtagcttggattacaggtgcatgccaccacacccggctaattttttgtattttagtggagacggggtttcaccatgttgcccaggctggtctcaaactcctgagctcaggcaatccacccaccttggcctcccaaaatgttaggattacaggcatgagccactgtgcccagcctatcttcttcttagtagtttatgagaagcagtcaaccatttgctgtgactattttattgatgaagaaattattttaagtttctgtattttaaaaatatataaaatccattaaatgtcttccaacaaccatgtaattttatcaattttcaattccttgaacagagcatctatttagcaccttatctttaaaggaccttaactattagatatacaatgatgaataaaacaaacatggcccctatccacatggcagttaccattagacaataaacaaatatatacataattgaaaactacggccaattacaaaagttccatgaaggattcaaacagagtggaaagattgaacagacggcatcttttcagttccaaagacttgtctgccctttaatctgagacctgaaggccaagaaagattcaatgcaaaagggaggatggatgcttcaggaagatagaatatcatgtgctattccccaaggtgggaaaacattttttatcctctaaaacttgaaaggaggtggtgtatttagagcaggggttggcaaactttttctgtaaagggccaaataagaaatattttaagccttgcaggccagatggtctctgttgcagcccaactacttaactccgctgtcatagcatgaaagcagctatagacaatatgtaaacaaataggcatggctgtgttccagtaaaactttatttacaaaacaggctgtgggccaaatttggtccatgtatcataatttgccaatacccagtctggatcatagagaataatgtcagccttctgactgaaccacctcaataggctcccttccagcttccactcttactcctctgtatagttcccagagcaaacgttttaaagtcctcactaagataatgatgccttctctgattaaagttttccagaagcttcctgttgaacatagactaaaatctaaagctgagatgactcaggctaggtgatgcaaaatttctgagccattgggaatagcctggatttcagagcgagacaacgaactttcctttctatctttatgcttgagacctggtgatggctgtgggcagggaagaaaaggagggaatatgagaatggtcaccagctgctcttcagctaaaaataatctcttccttttctgaaaactcatacctgccttactttgtgcacttatcatctaccctcggttatatactaatacacaaaactctctacttgctcttttgtttgatctatcctagcatccatggtctagtagcagatgtgtgagatttgatgaatggataaatattaattatactctactgcttgactcatagtaaataggtgaataagttaattaataaattagattttagagaagaaagcactaccaaagaagattctggagttttagtttaggaatagatgtgtcataaccggaaattggggaagttagtggaaggtcctgatttgtcaggtcacagacaggatgagtctctagtatggagcatcagcagtgcccaggagatgggtaaaatgagttctggagcttggaggagagagctgggttggacctagagataatgaataagggtaaagagttaaaggtaaaatggattagatgcttagatagagagataaacatggtccaaggacaaaaagtatgttgagaggaaggacaggaaaaatagaaagctttctatgaatggcaaaattgtatttttagtagagatggggtttcaccatgttggccaggctggtcttgaactcctgacctcaggtgatccacccacctcggcctcccaaggtgctgggattacaggtgtgagccactgtgcccagctgcaaaattgaatacgtacaagatttctagatttccaaataataacattactcaataggaatgaaggtctgaagagccctcaaggtcaatgctatagttatgcattgactttggtataaagttgtaatagggagaaggcattaatctagactcctagcaagatatttatttttttaaattgaaaattaaccatctctttttctcgcaatgttatattctgaaagagcaaaaaataacatatccttaaaaaactagatttggaatcagatacagcttgggttcaagtgctgaccctaccactcaccagctatttgaccttgggcaactatcttaactgctgtaagtttcagtttctatatccttaaagtgaaatgataatagtactttcttcagaaaatggttgtaaggactaaattagatgatgtatataaaagaccctgtcacctgcaggacacaaagaaatagatgttagcaattatgactttaaaaacatcttcatcatcatggcagtgagctctgtctctggaagttcttgattacagcagacaaaacagcataaaggtgtgtgctatgcattgagctgggtagcctgggcacttaatctaatctctcaatttacccacatgcagatgggggaaataatagcacttccttccctagaattaaagagttaacacattcaagacttttaacatagtgcttctcacacaaataagttaccaataaatatcattttgtaatttcatcattatcattattactctcatcgggtatgtagtgattttaaagcaagacataatgcaaattgtatttagtttctacttgaggtcaccttggaaatatatcaaaaggataatcataaaattcagtatcccaaggtcaacaaatttgcttctcatatctgttcttagaagtccatattctgtccaaatcaaggtagcatttgtaggaaatggtagtggatcttttgccccatgaaggagctcccttgtctctgcctcagttatcatctcctccaactgtgaaacccgttcttattctcttgctctcatctcctcccctctcctccacctccagcctcattcagtggagagagctgccttagactctgtggaaagatttggacaatgacccacagggcgaatgacccacataaaaagcagcagggagcttgcagggcatcagaggagcagagcaggactcaaaggcccagatgtaacactgattattgagggggccacagaaatgagcccccagcattgacagcattattataaaaaatatatgtatcctggagtggggagggcttgaaaaagatgatcttaacagaggtgtagacgaagaatagcagaggagcaacctggaaagatgtcatgaaagagaaattctcacattctgcctgggagtgaactgtgaagccagttcagtaaattgtaccactgagccatctcgactgcaatggcaaagctcactaacagcccgggctcccatctgcctctgctgctttctggctgtgaggcttctctgtgcctcagttttctcacatgcaaaatggaaatcataataggacctgtgtcctaggattattagtggactacatatatgtaaagcacgtagcagagagcctggcacatgtgtttgctatcactgtcattgccaccactgcatcattattacaaggtccatgtctgaagtcagtggtggcttcaattccagaagaggcaaatggcagtatgaagaagacttggggagacagaacagtattggcttaaagcaggggtgttggagtcaggaagagctgtgcccataccccacttctcaaacttagttggatgaccttgggcaagttatttgccactcaagggtatggtttcctcatctaaaaactgggaacagtaatcatacccacctcatgctattgagaggattaaatgacatgaagcatgaaaagcacttagcgtagtgcctgtgcataccaactgatccataaataatatacattactaaaatagtgacccaaaacattattcacagctgtaactcaagctctacatggagaggcagaggtctggggttgagcaggattcctgggaatctaagcctgcagagtcagatccataagaggcaaaacttcaaaatggctggtcccacacttgcctgtcctgcaaaagggtcttggcctccactttctggactgtcagaaaatcagtagataaaatgaatgtcactctgatggctaattatgagggctacgtggttgcaaattattgctagaccaagggagggagaggagaggagaggagagagctgggaacacacactgagctttcagggtcatgatagtccctagagccacccaggaggaagtggtattatttaaggaacatcttagtcactatctttggggtaactgtacccacataccctagtgactctcagaaaatactttgccttcattgccgaacaaaaaaagattcataagggaattaataaataagccaaataaaattttcgtctgccttttaattatagaagagtgattgctatgctaatcataatcagcatcaaggtcaaaagtttccacctctctggaatgaacatttagaaaacagattaattggaataccaatgctatttctgaacttccagctcacatggatttgaaacagaatgctgtatcttttaagtgtctttcaagaggagccatataatgctaatacattaattaaataaatgtcactccatgaacctgctaatgcccagggcagaggggaacaattaggaggcccatgaatcggtgtgattgcttagatggctaaagtaaaggctggtaattcattgtttaagtaatatcttgctttatctctgccaactgtcactacaggatgtgttgaaagtgtttaggtctctggttaatgtgggtgatgaaatataaatgcatttggagaatactaattcattttgatttcctcttgggcattgatgtctacaataaaaataaaatatccctttaatgtctatcactttaccaaattaaagccctacctcacaccatttacaaaaatagattccaattctaaaacaacaaagtctgtgttatccatacaatggaatatgattcagacataaaaagaaatgaagtagtgatacatgctacaacttgaattgaccttgaaagcattatgatagtgaaaaaagacacaaaatgacacacctattgtataatttgattgatatgtaatatccagtgtaaataaatccatagagataaaagattagtggatgccaagggctggggtgaggaaggaatgaggaatgactgctaatggacactgggtctcctttatattgtagcattgctgatagtagtaaaataactagaaacagcatgaatgcccatcagttggagaatagttacataaatcatcctatctgtaccttgtaatattatgtaactattaaaaagaatatgttagaaacttagttactggccgggtgcgatggctcatgcctttcccaacactttgggaggccaagactggcagattacctgaggtcagcagtttgagaatagcctggccaacagggtgaaaccccgtctctactaaaaatacaaaaaaaattagctgggtgtggtggcatatgcctgtagtcccagctactcagaaggctgaggcaggagaatcacttgagctcaggaggtggaagttgcagtgagctgagatcatgctactgcataccagcctgggcaacagagtgagactctatctcaaaaaaaaaaaaaaaaaaaaaaaaaagccggatgtagtggcacatacctataatcctaactacttgggaagctgaggtggaaggatcacttgagcccagaagatcaatgttacagtgagctatgatcacattactgcattccagtctgggtgacagtgtaagaccctgtctcaaaaaaaaaaaagaattaaaattaaaaattaaataaataataaaattatatatgtgtgtgtgtgtatgtatgaaagaaacatagttaccgatatggaaacgtgaccatgttacattaaattcaaaagatgaagaaaacacacccagtggttgatattgtttatttcaaggggttagaattggtgtgtatcagagggtggcgggggggtgttgattaatttttattatacttctctactctttaaattcatttggtgaatatctatatctctctctatatatatatatatatatagattatttttttccccaagacggagtcttgctctgttgcccaggctggagtgccgtggtgtgatctcagctcactgcaacctccacctcccgcgttcaagcaattttcttgcctcagcatcctgaatagctgagattttaggcacgggccaccacgcccacctaatttttgtatttttagtagaaatgaggtttcaccatgttgtccaggctgattttaaactcctgaccttgtgatcctcctgcctcagcctcccaaagtgctgggattacaggcgtgagacaccacgcctggccatatattatttttgtaatttaaaaaggttacttcaaatttaaatatataaacaataagtcatttatacattccataattatttacatattctagacactgtttaagggccaatatccacctgtgattacttaggatttctttataaagtataaaaatggaaaatattacattttacctggaatttcttcctaggccatgagaaagaaaggctcaaatgtaaatgaagaaaccgactctgagagattttctgaggtttcagagatcaccttgccccacacctgagcagatgttgaagtctccacttccatatccaggatctacttggatgcattccatccaggggagcttcttccttctgtagacagcctgttttgtatccacatagctctactcttctgaaaattctttcttcctattgagtcagacctccctgcccaggggtccccattgcagaagcagcttagaacacaggctttgcattcagggagacctgggcttgtgccctggttccattacttaccacattgtgaccttctgcaggtccttcactgctttgtgcctccatgtcctcatagatagaagagggtcatatgtcttcacgaggtagtcatggggattaaagtagatcacatctgcaaaatgcctggtagacagcttggcacattgtaagaatgcagtcaatggtggctgctatgattagctctaaggccacaagcagaagatttcttctgtttttcctaacacgtggcacaagactagtacttttctatccattcgataattcactcattcatttatttattcatccattcatctattcaataaatatccaaaggccttaccatggcctatgaagccgtgcataatcaggctaccccctccaccctccatttcccctaatctccccagtaactctattaccttgccttctacccttgtccccttcttactcatgcccttttcttcacagcctcctctgtgcccactgactggtataagtcagtgattgaatattactgactttacaaatgcacactgtcttcctgggtgttcctcaaacacatggagcacttacctgccagagggcctttgctattactgtgtgttctttctggaatattcttctcaccattctctcacatcattcggctatctgctcacatgttgcccaacaagagaagctgtgctagaccacagtgctggctcttaccattcccaatcctccctgctctgctttatttttactcaaagcactgctgttaatctatttctttattgtctgtttcctccaattagaatgtcagcctcaaagtaacagaaactcttttctctcctttgtatccccattgtctagagaataacctgacacatagtaggctctccataagtaactggtgaatgttttaaccaacatatgcgagcacttaccatgagccaggtgtgctgatacagaggtgaacaaaagcagcacagtgctttctgcttcagttataacagtcttgtcccaacacagcatggctttaacaagccagctagcagactgtcatagtaaatgttgtttatgtacaaggtgtctttatgctgagggtaataaaacagccctacggcgccaaaatcatcaagttgagtgactgattaactgttagaccataaataattcgcattggcaagaaatattctcacttcagtgtgtggcagtatattgtcacttctctggattctgtctgatacattagaatattatagactaaaaagcaatcctaaagggactgtgccctggcagtgtaagtctgagacaaaggaaggaggaccctaaaacatagggggcgtggggatgtggccatggccaagttcatgagctgctttcactgtgcatttgtaaaggcaatagcatttgatcactgtcgtacctaacagtgtctgtatgagtccattctcgcattgctataaggaaatacctgagactggataatttataaaggaaagagctttaattggctcgtggttctgcaggctgtataggaagcataatgcaggcatctgctcagcttcttgggaggcctcaggaaacttacagtcatgggagagggtgaagtgggagctaggcatctcacagggtgggagcagaagaaagagagagaatgggaggcactaaacacttttaaacaactgtatctggtgagaactcactcactatcaccaggcaactgccaagggggatggtgttaaaccattcaagagaaactactcccatgatccaatcatcccccaccaagccctttttccaacattgggaattacagttgaacatgagatttgggtgggaacacagacctaaactatgtcagtgtgcactgaggaggctgtggagaaaagggcactcactgtgcctgtcctcaagaactagaaagtggctctatgttctgacctgctgacacttgtggttatatcttgacatcaagactaatggcccagccaatgactatttggtacagtcagcattttcaggagtttggagttgggggacaagagaaatctggatttgaatccaggttctcctggtttttagctgtgtgaccttgggcaagttagttgacctgagactcagtttctacaactctaaaatgggattttaaaaagttatgatttcattaataaatattaaacacaacattgcatataaaccatttggcaaaatccctgtcacatggcaagggcctagttatcacagttgtgtttgttcaaatgagtcttaacatctaatttaagaatcccctccagatcctaaattgatggtagctcagatgtcatgtaagacaaatacaagacaaacacaagacatacatgagaatgtttccctgacttcctaaaacaagaaaaaaaaagtgttattgagatagtttccaggaatatacttatggggtgaagaatccctatggaataaatatggttcagtgatattaccagtcattatataccaaccaattaaattatagtttcaaccatgccagtagagtaattcacggtaatggatggatatgctacagcaagagacccagcctaggagtggggaaattgggctctagccccattctgccactgtatagctttgggaggtcccttaccctctggagccttggtttctcaattgtacattaaaaacatatcatccagatgtttccattttaagtatccttagaacactaagcacccagaccccattttattagatacggctctgccatctaaatccttgtaacaaatacatctacagcatatagtgtaatcattgaggatttatattaaaatcagatgtagcaaatggcagcaagcgagaaagctagaattttctagttcatctcttatccacctctggggaattgatagttatcttaaaggtacaatcatttgaaaactcccgcatctgtgtatgggcactgattatgttcctatgtttatacatagagtaaacaacgtaggaactacatagatgattcttaaactatatagtataagatttgctttttatagttgatgatataaatatgcattttgtcgctcatgggtatttaaggaatttggaatagtattttggcaatctaaaatgtttcttttatttgagaaactaacctccccatccctgcctggaaagtaaaggtgacaataatggctatttaagacactgaaaatcaaattaggtcacatccctgaaaccacctggcaagctgtgtcacaggaacgttcgttgctgaaatggcctgggggcagatagtaacacagatattttgaagtatcagaactgcaccctggatctgcagctaggataggagagtggcctggatggctctgactatgaaaccctgatggaggagagctgtgaagggaggggctggtgtcctgaacagtagaactgggaaagggaggtgatgtgtgaaccctgctctcaagaacctgcagggctggccaagcggaaggggattctgtttctagagctaggtatttggagattgggggagagtgctgtggtttgggagaaccttcaagaatccagtccaaaacctggatgtgtggctccaggaatcttgtacaaatgtctccccatgataactttatttccccctaccatgcagaaaccccatttcgaatcacagatccgggtcacatgccaagacggcatcttagccagggcctctataggtggctgtacctcagagggccactgagggcattacctgtccatgcagcaaagacagccaggcactcaggacctggacacatggacaccactctgatggggtcagtccccagagggctctagacaatgtcttggcagcttttctactatgagttcaaatcctggctctacttctttctcaccctgttacatggagacgtgagtcataacatacaacaatggtgggaaaatgagtttttctgcattttggagaaagctagaggcagagatatcattcagcaacgagggtgaggcttctctgagactgtcttcttttcaagatcaagcagagtctgatatctataaacattcctgtaaacggagattgttatatgctttctgaaatggtataaaagtaatataagatactttaggaaagtgtataagaaagtaatgttatattcttctgaaatggtaagcaaacttcagagggtcatagcatagcaagaattgagctcctgagattaagcaagtcctcatcatctctggacaatattattggcagctacatgtcgctttgggctttggggtacacctacttctcctccttcctaacgtatgtgtgtgtgtgtgtgcatgtgtgtgtgtgtgtgtgtatctcttcctgtctatctacagcccaacagaaactctgtactgactccatgggttggcgtgaaaatcaaatgaagtcatgaatataaagcatttagcacaatctctggaatatattaagtgtttaattaatggaagttgttgtcattgtgggtttatctggtgatatttgccaggaggggagaatgagttgaaggaggactgagcagctctattaggagtctgattcctccctcattatcgaaagcctctaagtcagggaacactgatactttgatgtccactttgtctagagtgaggctcaagtttcaaggttttcttcctttccctaactttatggccactctcaggccataaagatatccagcagaccctgggtttgtggaagacctgagcagaggccctcccaccccatcacacacatatatagtctcaaatagaaaacctcctcttcacgctagtactggctctaccccacgtgctttaccacttgtcacctgttttccagaaatggacatgtctttcccctcatcacgtgacttcagagattccttttatacttttcagtgtctgcatgcttgacaccaaatgttgtcacctcctgccattatcttttagttgtactgaaaaagaaaaaccagatccaaggcccatgagtttcttgctagcctatcaggatgctccctcttctccaactgaactgacagtatcaaaggttttgccctcgtccatttcccgggtaggtctctgacaatagtatcttgttccctggctaccacaatgagaagtgacaaggacattttcctggcattgcaggtcatagctcagcaggagctgacatggagaacacacagaccccagacaggtctccccgctgggtgacagataccaggcccatcaaactcagaaaatctcttcctttacttctcttctacatcagtcaagtcaaatttagttataagcaacagattccaaatctggctggcctatgaaaaagagaagtactgcctggaagaagacaaagacagctcacagtattgagaaggatgaagagcctggcctcagaagggacagaatgggacaggtagagaggtgtgttagcagaagggccaccactggggtgtatctggcccacactgtacatgttaagattccctgaagataggctgatgggcccagtgaggtcacaggcccactggaaagtggaataattccccaaaagaaatctaggtattgccgccaaagaggcagtgaaggtataggcagaaaagacgatgatgctcactgataggacagcacccagccctctctgacattctctggagcagctcaacccaccctccagattgggttaactgagactggggaaggaacactgttcagtgctgccatcccccacagaaggcagaggtggtccatgggggccctacctgcccatccagaacaatcttttgagagctgtgttcaaatggccatctaatcaatttcttttttttctttttctttttttcctttttttttttttttttgggatggagtttcgctgttgttgcccaggctggagtgcagtggcacgatttcagctcactgcaacctccgcctcctgggttcaagcgattctcctgcttcagcctcctgtgtagctgggactacaggcacgcaccaccatgcccggctaatttttgtattttcagtagagacggtttcgccatgttggtcaggctggtcttgccgtcctgacctcaggtgacccacccacctcagcctccgaaagtgctgggattataggcgtaagccaccgcgcccggccccccatctgatcaatttctgcctgtttcaccatcactcgcacgagcccagttttagatatcttgccgtttttcatttatttctatttaacctcaatctcttcagctgcagaattaaaacctccatataaagcatgattttcagcgcagggtgggttaagtgaaaggaatcccatgtttagggtcctacctcgcacctgagccccagttttctggtttgtgaagtggtaatggtcatttcctatagcccacctacgacctcacagggaaggggagagaatgagtgttcttgaaggttctctacaaactgttgactgggatgtgtctgtgcagagaaaatctgatccatctctaagaacaacagtaaacatggtggtgtttcatcaaatgacaggccatcagggaaagagtgaggggacaaagcagtattcagggtaagtcacacatgcctgaaaattaaatttcaagaatgcttgagagatgcaagcaaaggctggataacagaggagtagagggccacagaagaagaaattaatgtgactaaagagctatagatatcagatgtcttccatttattcatttattcactgaataaactaagcacctgttacttagcagacatagtgctgaataccggggacacagagatgaataaaacatatctcccacgttacaagtcctaatggtttaggaggaaatttgggcattatgtccaaagcaaatatttttagggttgttaaaataaaggcagtcatctcaacgacttttttaagaaactaggggaacaaaaagaggtgatgcatagtattgagttgcctgctgtcttagtccacatgcctttctgtctgtagactgcagaagcaggacctgagcttgctctctagagaaggatcccagagggaatctcattcactagaaattaccaagttcctacaaagtcagagggaagtcattccaactatagaagcagaatgaaaatttgcattttcttctctgtgacatgaaacaaaatcaccctaacctttggaatctagtgtaaagtgaacacctacatgcagcatctagttacagtgcagtagatgatgtataatgtatgagctaatggcctttaattaaaccagtattttctaggtttggactttttatttatatatgtatgtatttattaatctattgaatgaaagcaaatggaagcccaagctaatcttctgcaaatcccaccctatttttagtggagaggactcaagtaagagtgatgattttagtttccatgttgttagggaaacacttggggtcattacatatttatccacagttaacaactgacaatcactgtaattgttcagctatttcatttcagtcatttcatttctgaaaatgactcgagttgcctctataattcttttgattatgccattctctaagaatggagatgattgattattctattctttgaccaactaaaaccatgacaagctctgtcatatatgtgcccttataatctcaggcctaatgaaaagtgtaattaatccaagagggaattttcacaagtgactgtctcaagattgatttagaaaactgttaagaagttcgtatgtgtgtatgcatgtatctatgcatgtatctgtgtatgtgtatttgtttaatcagagagatttggaccaggtaaagaatctcttgacagtgttaaaccatccaataaattatagcaagctgtcttctgcagcttcatgagcgtgatatcagcacattgacagtagaattgagcctatgggatatgaatgtgataacaggactactaacagtcagatgcttgtgattgcaacattttaaatattaatagaatgtttaattacctttggctctgttcctttcttaatctcccctctcctaaccttcagtgtgggaatattatgacaaaatgaagactattccagagaaaatttaaaaaaaaataaaaataaaagctgttttttaaaaaaaacaacaaagtaacacattgatagtccaagttcagtaatgacttctcttttttttatttaaagttagttcaccttgttatatttgactatgatttcatcacaaataatcaccccagttggtgctttctgtgttctccaatctattgcagctgaaatctcacttaaaaatttaagcaaatgtgaaattccatcaacttgaagagagtgtagtctcatttcacattaataaaatttggttttaatcagcatcacagaggccctgatttgctagtttagtcactttaagtaggcagtggaagcccaaggatgcttacctaaagcaaatccaatctgacagtttttactgcactttacattcatgtttaaagccccaaataatatcctttagtggtttcagcaaaaacaattctcatgtgaaactttgctatgtatggataaagacagttgacctttctgggatattcactctcaatatttgagcaaccaacatataacacacaaatatcctcagctagccgactgtcatcccctgaaatttccctcaagagattccccaggtcataaagggagacgcactgctgaaattcagcaaagggaaagctccatgggcctcttaggctcagcaacttacaaacatgtctatttcctcccatttcaggtgagcaaggcccagcagttctccatcttgatcaggataggatggtgatatgaatcaagcattgttactagctaggcatatttacagcctttcaacattccatcatgtgtaaggaagccacctgttcccaaatccatcagccatgtggccagtgcgtcccacaaatggaggtgaaataaaagtttttagtaggaaaataaaagccagctcctagactgtttcagagaagtcataaggggcatgaacctttgtgatgtaccctgcagtgtcttagcctgactttcctatgacagtaacagtctatttctcagaggtctctcagctgctttgacttttctagataaattaatagaaatgaagccatttcacatgcttatttgtccagattccaggccaaagtgtgggattcaaaccagaattttaaaggctcttcttgtttctgaggttgccttcggtctgatttgaagagaggtaacatgctatatagcctggccccaaactgctaccaaggaatgtaagatagatttttacatgcgatttgtgttctcataatgggatatttctgtaaaagatgtgataaagtggaagagtcttaagagtgaccatggggctgaaactaagctttgccactttctaattgcaggactttgggtcttggcttcctttccataaagtaattcagcgagatgctatggaaagaatggggtaagacatatgaggtggctgttgacatggtgtgaggaggaagagcagctgctgtgctgggctaggagccagaagacctagactctacttaggctccagaaaacttgttctgggtctccgacaccacttctctctgtactttttcttcattttcaaaatgagaggctgggaccaggcaaccccgtgcatctggtggctggtgactcaggtactctgtatattcatcctgcatgaatagtttaaaagtttccaaatctaggatgttttacagagggatgggatggtcgtggagcacaggttttggaatcagtcacatctgagtttaagttcaggtctcactatttttagcaatgtggaatggaggtaatgatgatgccttctcgtaaggctgatgtggggtaaaaattaagttaataatggcagaaagcttagcttagaatgcttgtattcgtttcccatggctgacgtaaattaccacacacgtagtggcttaaaacaacacacgtttgtcacctcacagttctgtaggttagaagtctgacaggttctcattgagctagaatgaaggtgtcggcagggctatattcccatttggaagctgataggggctgacttctcttcctcacagttcatgtattgaagacctaacccctagtaccaccaaatatggctgtatttggagataatatctttaaaggggtgattaaattaaaaggaggtctttaaggtgggccccaatgcaatctgactggcacctgtataagaagaaaaagtgtggacattcagaggcaccaggaatgttcctacacagaggaagaacatgtgaggacacagggagaaggcggccgtctgcaagccaaaaagcaaccctgctgatgttttgatgttggacttctggcccccattactgtgagtgaataagtttctgctggttaagccaccattggtgggcatttctaatggcagtgttagtaaagcaatgtagaacctttgggagggaatggtttccttgcctttccaagcctctagaggctgcttatgctccttgatttatggccctcttcctttactttcaaagccagcaacagaaggtcctgtccttcacacagaacatcaccctggccacctcttcggactcttcttccacttttaagaacacttgagattacactgggcccactggatcatccaggctcctctccccactttcctactttaggattggctgattagcaacttcaattccatctgtgaccataattctctcctgccaagtaatattacatatgcatgggttgggggttagaatgtggatatctttgtttggggtgggggaggattgtgcctaccacaacgtgtagtgaattttagctggtatgtggaataggatttttatactgtcttagtttattttcctggctccaacgctgggatgcaaattaacaaacaaaaaagtaaatctcactgagtggaagctggggaactgtgctcattctgtagtttgtctttgcttcctccaatacagcacaagctcctgttgacacaggcttacgctggtgcacagaataagtgatggtccattgagttgaagcttcagcattttgatttaactgatatttctagcaaatttttgaccttgcactgtttatgtaggggttttctggtcttcttagaatggtaattcagggcaagattagccatgccatttctaacagatctgctgctttcccctttagaaaggaaggtttcagtgtttattggagaacaaagactgtgtggtttccacggcatgtttggcctcaatatgttcagagatacaaaaagcttggagtatagaaaccctgtaattgtgtccttcaaatgtatctttttggcgtaaatgatagaaacccgattaaaagttgcttcaactgaaatgggaaggtattagttcatgcaactacaaagtcttggagtggatctagctccgaacttggtcagatcgaggattccatgaaatcctaaggatccggggtctctatccccctttccctattctttgcttttctccacattggcctcattccaaggaaggccctgtcaatacagtgggcctggcaaatcagggcttagattaggcttacagccagcatgccacaggcaaagagaactcttccttcccacaaatccaagcaaaagtctcaggatgtctttcctggatcagcttaggtcatgggtctatcccccaaccaatcactctagccagagaggcacaaggcaatgattgaccaggctgaggtcaaggccaccccagagctgtaggcactggaggaggcatcagctccacctcacacacgtggatgaagaatgaggagaagtagttcctgaggcaaatcaaggtagcatttctagaagagggggcaatggatacatggaatggaaatataaccaacatctatactcaggtgaggtgcttggcttttttaaaatgttactctggagaatggagcttcttttttttttttttttttttttttccccaagatggagtcttgctctgtcacccaggcaggagtgcagtggcgcgatcttggctcactgcaacctctgccccctgtgttcaaacaattctcctgcctcaacctcccaagtagctgggatttcagatgcctgccaccacgcccactaattgttttgtagttttggtagagacgagattttaccatgttggccaggctggtctcgaattcctgacctcgtgatccacccgtctcagcctcccaaagtgctgggatcacaggcgtgaaccactgggcctggcctggagcttcttatttaaatctgtcttatttgggcaccaaacagcccctactggatgctagacagacctgcccagaaatttatggatggcaagataaatgacacacaggcactgatggatgtgaaatcatgtttattaatcacacaggaaacaggcaaagggctccctaaggagaagggttcaggctctctgttcagcgtgaagtgagggccatgggcaggcaacatcagggcttcgggttttacagagctcaggggctggggctggggttcaggtttccatgcacaagctggggtctgagtgatttgaacctcactgcaagcacaaagggacagcatatctgggcttcctcattgacttgcccagattgaggtcaggtcggaaaggggcttgagagtagaatagagcttggaagctatcagcagtcagacctcaaaacagagtcaaacccttgacatctttttactccagtttggggagaaaacccatagaagccaagggttcaaactcttgcctaccctgaaccagccttgcctccccgcatttgtttctgattggtgttgaaaagggatcctgggggacattctccaggctaccttctgttagccagtctcatgatacctgcaggaaacagatatgctttgcacacatgggtttcaattggcaagcaatggcaatgcatctttttttcagaggaaaatggttatcatggaggcaatggaatagatgttgttgagttcagcggctgtgcatgaggcacggtgctagggctgatgttaatacaaagatagataaagcataatgttcccgttcacaggagcaggtgatgtagtacaagagatgagggcctgacttgtaagacaggacatgtcatgagtgggtcccaagggtcacatacaagtggtacaggaggcagacatagattatatttcagactgagaggacatattgctaccagatgatgctttacaaagatgatgtttgaaatgattcttgaaaaaatagtgtattagtccattttcatactgctacaaagaccttacctaagactgggtaatttctaaagaaaaagaggtttaatggactcacagttccacatggctggggaggctcacaatcatggcaaaggtgaaggaagagcaaaagcacatgttacgtggcagcaggtaagacagcgtgtgcgagggaactgccctttataaaaccatcagatctcatgaaacttattcaccagaatgagaacagcaggggaaaaaactgctcccatgatacagttacctcccaccaggtgcctataacacatggggattatgggaactacagttcaagatgagattaggatggggacacagccaaactctatcaaacagtagtatatttatggtcaggtgctgaatgtatagacaagacagggaaacgctaaacataatatcagacggtgccaaaaagaacaaactactgcacttcacaacctgattgagtcacagacattatatcgagtgaaagaagcccgatacaaaacaaatacagtatgattctgttcctatgactccaagaacaggcaaaagtaatgaatgaaaataagcataaggctagggatgacctccgggtagaggagggtattgatggggaggggtgtaaggagctgtaaatgttctcatcttgacttgaggggtggttagaggggttcaaaatgtaaacgttcataaattctacctttaagatttatctgtttaccacatgtgcattttatctaaatgaaagaaaaagggcacaaaggaataagcgtaatcgtaaaacttatgtttccatgcatggggtaggctgaatagtggcccctaagagatgtccgcgtcctcaaccctggaacctgtgaatatgttaccttacgtggcataagaaacattagaggttatgactgagaatcttgaagtggggagattagcctgtatgatccaggtgggcctgatgcaaacaccatgggcattataagagggaggcaggagagtcaaaggtggaagacagagatgggatgacagaagcagaggttggagtgatgcactttgaagatagaagacgggccatgagccaagtgacaaaggtggcctctgaaagttggaaaagacaaggaaactgattctctcccagaacctccataaggaatgatggtctgccaataccttgactttagcccagtgaaactgatttcaaatgtctgacctccaaagctgaaagatagtaaatttgtacagtgttaagccaccaagtttgtggcaatttgttacagcagccataggaaactaatatagtgcatattatttgccaaggacagaattaaacccttatgatatggttaatctcaattcatcttcataagtgccctttgactgaagctattaccattatttatcctccttttataaagcaggaaactgagacagatcaagtaccacccccaagcaaagaaaatagtgaagccatgatttgggtccagacactaacactcgaggtcttcatcactcagctttgcccctgccaagcagaaacggcagctggagcacagcctcagatggcatggtctggaggaaactggagtccaggctgtggcttgttctgcctgcagagcattccacccagccccctccaggtcccgtggccatgaggaagtggtgtggactgagaggttgctgaaatagctttgatgacaggagacttccttcagtgcagtgttgagcattgaaatatttcacttgtgcccattgggcatcacatttcacgaagatgtgttaactaagatcactgaaataaaacataattctctcccctggatgtactataccgagctgctgctgtcactgtgtgtgtgtgcatatgtgtgtgtgcatatgtgcaaggtggtgttggtgagggagttataccaagttgttggctctgtctcccctatttcttggggatctagcagactcatctttatttatcaaatggtagtcagaaggttgtacaactaaccttcacagagaatttcatcaacaaacacaaaagccaaacctgtggctcactggtttcctgagctccacattcagctctactgacaacaggatgctacttggccaattaacagcaggatgtgcacatatttctctaaaccttttgggtggttctcccagtgagtggctctgctctctatttttcctttggacacagaagcatactggttaaaactaagggctttggagactcagaataccagctctacctcttacaagctgggtaaccttggcaggtcacagaccttcaatacatattgagtatctgaaagaggatgttttcattatcccaaacccagaaggtcagatctttcaagaacctcagaggtcatctagtccaatttccacattttataggtggagaaattagattcagaaaagaggcgagtaggcaaatggccaagagacaagtgagtggctaatccaattgtatggataactgccctgtgtaaggttagctgatcatgaaaaaaattaaaaaaagcagtaccatcagaagcatttctggtagactattaagatctatgatatggtaatcatttgaacaactatggttattagtcttatttgcagacacagtgttcaattatgcagaccactctagtgcatcagtcccagggaactttcttagccatcagcacagagacaattttaaatgaatatatgcagcatttccccagacctactcgtgatacccaggagaccaactacccatgaaaaatcagttcactacaagaggaggcatgggggctttgaagtacttcttattgcatggtagtcaagtaattttttgaaaaaagtaattttactttcttgcattcagggctatccaaaaggctatatgcaaatctccaaaaaagcagaggttagtttttgtctttgttctagagaacatccctacatagcaaaatcaagaactcattgtccatggatccttcctgatgctcacaaactggttttatgtatttatttgcaacatgaaggaaagcagacttaaaataacgttataaaaagaccacagcacattgcacacatatatttaattcagtaactatgatgtatagaaacgcttctggaaaccttagaacttaaactattaggtcgggtttcaaacacctgccactattggagcaataaaatatttttgtccaaattattcttctctgccccctcctcctcttctcctccccctcctccttctcctccttctcctccctctcctccctctcctccctctcctccttcctcttctcctccttttcctccttctcattcttcttcttctttcttctttcttcttccttcatttctgccatgaactgtgagtaagtcaggaccctctgaggagtcttaaataaaaccactgcctcttggaagcttgttaaagtctagagaggtttcaccgtagcaaaaactaaacaaggcatcctacctagaacttggggaatttttttcaaagcggttcacacaaaactgactcaagtggtgcaaaggggtggggaatgggaaggtgggttagcctttcagttggacaagatgtactctgttgatgagtatggctccaatagaagtccagaagaaaaagctctggatttggctttgtattttagtataaagggttttcagctacctgggctcaaagactggaatgatgagctttccacactcatgcagtcagctgatgaaaaagcaatgcagccagagcaaaaaaattaggaggaaccttttcttcaggcttcagccttttcttagcctagaaagaatttcattcagcaaagagctcagcaaagagtccatgaatgggaactctgggatgccccttgaaatagatctggatattcacacatagcctgtccttcgggtaagcctacaaatagattttagaaccaccttcaccataaatatcatgtctttttatgcccttacattctctgtccatcagcctccttttttggcatactgattgcattagaaatcctagaggttttcttagcaagtgaagaatggtagataggatgcttcccattgcccaggagcttgtctgctttattgatatactacttagtttgaaagtatcagttgacttttcagtcctggggaaaaggcatgggaatacttgttattctaaggacaatttaaaaatttagtcttgcagttgttctgtcctttaggaaaagtcttgtgctcaaagtctgcctcctatttaatatatgaaggcagctgtgggataatggataagaatggtatactgctgttagaatggaaaagaatgctatactgctgttagattgtgagtttttcacttatttatttagtacctattcttacacagaatttactatatgcccctttcctaggtctagggatatagaataaatatcagagtcatcaggagtgctgtggaggaggcttacttcagtgaacagaggaaaccttttggaagaggtagaatttcagctgagacccaagccttgagagaaaatcacctaagacaagaatagaaacattccaggcagaggaaaatagccaatgtaaaggaactggggcaggatacagcttattgtatttgagacttaaaaaggaaaagccatcaaataaaatggaaatgtggcaaggaaagaagaaaatgaggcttaaagaagtagcaggcactaagtcctggaaatgcttatatgccatagacaggcatgtgggttttattcaatgtatagtagaaagtcattaaaaggtttgaagtaagaaaatgatgaactctagctgacacctctcagtaagaatctggctaatgtgtagaggacaaatttaagaaaacaagcataaaaaatgagagagggaaccaagagctgctaccaaagtccagcaagaaatgatggtggtttggcccagggtggtgttacagaagcaagaacagagagatggacggagagagaaagggacagttcctgaatctggagatatactaaaggtaaatggtagatttggtatgggaggaatccctatatgttagcacagtggatggaataggtactcaaaagttttctcagaagtgaactaaatgtggagtttaggttgaatttcaacttttgccctttatacacctgtggacaaatccctaacctctctcagtgaaggttggaggggatttcagacctccaagtccattgtaagtgggtgtcttagtccactttctgctgctatcacagaattggataatttataaagaacagaaatttatttggctcatggttctgaaggctgggaagtccaagagcatggtactgacatctggtgagggtcatcccttggaggaagggtagaaggtggaaacaagcacaggagacagagagggaagtaggccaaacttacctttttatgaagatcccactcccatgataacagcattaacttcattcaaaaggacagagcccttgcggcctaatcacctgttaaagttactacctcttaataccatttaagtggcaattaaatttcaatgtgagtttgggcaaaaacagtcaaaccagagcagcagccaaccacccagatggaggggtcataatgaggatggacatttctggagatatcagtgtccatattggttttaccaaggcttcttagtattcactgagcaggacctgggcaggtgaccaggaaaaccttgcattttatttctgcctccaccctgactttgagctgaacttaccgtggacccttcacagggcagaaaagcagctaactctccttgaccttctgtgattgactttggatgagtttgtccagaaacttgtcagttcagatgctcatttggctgatggacaagaagcttgtgggaaccaggctgctaccacagacccaactcaggaaaatcaaagagcagcctgggggcttttagaggcttactcatcatagagagcatttgggtatatggttaattatatgctttattacggatgctaatttgtgctggaagctgatacagtgtgtgttagcatttagctttagttaatgaagttgggttaagcattcaatatatcactgagctcacaatttctcctcttggctagaacaacatggtgtggaaaactgaggggtgatggtgttggggaagagaaaacattcacacagtgagttccttccctgtaactctagaatgtcttcagtgctgcattgtgcttgcaccattttaatgtgagataattttcagtgggataaaaccctgggcatgtgttaaaaaagaagtattgttgtgattacttattagcataatcagaaaaagcccctgtgtgggctccaatgaggccaactggagccctgttgtttcttttttaaaagtcttcatattttaagaagaagaaaaggatgctgacataaaaatgccttcagtgtgtttcactcagctcagtacctaagttaaatcattgctgataactttaaaatacagaggataaacaaacgtatgtttgaccttcgcaataaagaaaatcatgtatttgctctgctcccattggtgttaagagaagctacgtatgtaaatctctgacacatcaatgaaataataaactcctggatgagccatttaatttctctttcatagctacctttcacgtttggctaaaagaagggggagaaaaccaatgtcctcgataaaaacaacttaggttgaccctgattcttcggcattcttccttagagcccagcttcagagactgggaattcaagagggtctgacagggaaggaattgagctgcccacgtggggactgtcaccagagacccaagccttgcagaaaggctggtttgatagcctgcctgagtccttttgcctccctgcttcccccatccaaggcttcagttgtacctatctgtcctctactgggaattaacacaagctccagctgctttgggatgttttatagtcttgatgggtcgaataagaggctacttttccttgagtacttactgtattcgtccattttcatactgctatgaagaaatacccgagactgggtaatttataaagaaaaagaggtttaatggacttacaggtccacatgcctgggcaggccccacaatcatggtgtaaagtgaaggaagatcaaaggcatggtggtaggcaagagagcgtgtgcaggggaactgcgctttatacagccatcagatctcatgagacttattcactatcatgagaacagcacaggaaaacccacccccatgattcaatttcctcccactgggtcctcccatgacacatggggattataggagctacaattcaagatgagatttgggtggggacatagcaaaaccatatcacttactaagtgccagacactatgctaggcatttgaatgcaatatctcattcaatcctcgcaagagacttactgaggccagtgttcctaggactcatgaattgcagataagaaaaattgaaggcacagagctggtaaggggaagtgactgttaagtcacactgattccaaagtttaatgttctgaatgaagagctggcaaactttttctctgaagggcatagaatacatatttttggctctgctgggcattatggtctttgttgaaataacttacttctgttgttatatagggaaggcaactgcagacaaaatacaaataacatgttctttcggggtaaccagcccccaagatttcaacgtagattcttttctattttccctaagtgtcggccagtctgagaaataaagggaaagagtataaaagagataaattttaaagctgggtgtccgggggagacatcacatgtcggcaggttccgtgataccccctgagctgtaaaaccagcaagtttttattagcaattttcaaaggggagggagtatacgagtagggtgtgggtcacagagatcacatgcttcaagggcaacaaaatatcacaaggcaaatgggcagggcaaggtcacaaggccagggcaaaactagaattactaatgaggttcccggtccgctgtgcacgcattctcattgataaacatcaggaaacagggtttgagagcagacaaccagtctgactaaaatttgctaggcaggaatttcctaatcctaataagcctggtttcatccctatttacaactgcataaggtagacactcccagagtggccattttagagcccccccgcactacccccctgggaatgcattcttttcccagggctgctaattattaatattccttactggggaaagaattcagcgatatttctcttacccgtttttggcaataagagaaatatggctctgtcctgcctggctcccaggcagtcagacctaatggttatctcccttgttccctgaacatcgctgttatcctgttcttttttcaaggtgcccagatttcatattgttcaaacacacatgctttacgaacaatttgtgcagttaacgcaatcattacagggtcctgaggcaacatatatcctcagcttacgaagatgaggggattaagagattaaagtaaagacaggcataggaaattataagagtattgattggggaagtgataaatgtctatgaaatcttcacaatttatgttcagagattgcagtaaagacaggcataagaaattataaaagtattaatttggagaactaacaaatgtctatgaaatcttcacaatttatgttctgccatggcttcagccagtcactccattcggggtccttggtttcccacaacaatgttccactaaaaatacatttacaaaaagtgtgtgtagccagatatggctgtcaggccctagtttgccaacttctgttcctgaacggttgtcctttctacttccccaggctctttggtgaagagttcaggttttggagtctgacggagccaggctcacattcagtctctgccacttgcttgctgtactctgttggagaaatctcttaacctctgggagcttgtttttttccatctgtgaaatgggcagaagaccaacctaagatggtagttgtgaaaatcaaatgcaaaacatgtgtgaagtgtggaacacagggcttagcattgggatagctgttgaattgtggactctggctactgagaggtggtttaacaagggtgctcctgcctctgggaagagagcataaacctaggcctgtcttcagtggctgagcagccccagaccaggcagaggaaggttctgggtccatgcagacttcaactttagtcttcagtgttcattccttgtttctgccccataagaataccttgctatcggggaaccaaagtcaggagcttacaatggaaattcaagcccctaagatcccagggtacatgagctccaatattaaagcacaaaggaggaaaccgagacattatttaaatgctttttagagtaagagatacaaagagtccctcactgttttacacttgtaaagagacccctgctggattcccaggtataatctgcagtaaaaagctacagggctacaacaaggcctctggttccattggctcacttcctttttccccatagcctctggcataaaaacgcaaaccagagagacactttagaattcacttgtgcagtgctttttctgtcaatcagctgctgacagtggaaacacaaagaaggtgacatgacacaattgctgttaatatctatacttctgatatgatcatcctagaggaaccacagtcatcagctctctgctcatggctccccagggcacagaacactaggcaattaaatgacagaattaggttgaaataatgctaatggtgctgatgagaatgcaaaggaccaggcaggctggggtcctagctcagcctcaggcaggcagagtaagtagggttgggtgtggattgttttgcataacaatagtgttatgcacatttatcttttttcctttactgagacaagcagagaatgattcattcctttctctcctatcatttgcttagtagattaaactcaaaaaagcatttatgtattagctcacataactgaaaaatccagaggtctattgtcctcaggtgtagctggatccaggggctcaaaccatgttgtcaggacttagtgtctctctctgtcttctctgtatctctctatatatctccttcactcctggaatagatggaaaaaaagtagaagttcccaagggcaataaaatcttataactaaggtgtagagttaggtaagggtggtcagaaaaatttgcaggctaaggaaatgtttgagtttgaaaatacagcctccaaggaggggtccgaggcaatgtgttttgacctgtgtcctctgaacacctacagaagagtcttctgggattggttgccatgagacagtttcctgggcttcacctcagacctgcagaatgtgattcccaggaaaaggccttgagctatgcatttctttagcaagttccctccaaatcttgtgcacacttctgtttagaacagtcttaggtgtagcagcctctcattctgcacaattaataaaatgtaatttaaggatatacactgaagctagaccaggaaatatataatatgtagggtggatactttaaaaaaaaaaatcagaacactgactctggaaggctgttggatcctcctgctctccaatcccttgagtaacatacataggcaatcctgacttgcaggtgaattctgctgtaggcagagagcctccctgcgaccttagaaggaggcaataacttctttttcatgcaacagtgcagaaagtatggaaatcttctgaaaatcccatctctagctggcttttgctctgtatgatttacttagagaaaagagcctggtagattctaaggccccaggacatttccatgagctcctttcatccatcattccagtcttggaaagggaaagtgcgatgtccctaattcttgtgcttctcgatcaatcttcctgctacaccagatcctaacatgggatgtgtagtctacagagagatggctgggtcatcattcttgctctgccccttacaagctgagtgaccttgaacaagttatttaacatctctgagtcttagttttctcctaggcagcacctgtctcacaaggtggtggatgaaactaagagagaatgcatgggagtgagtcggaggcatttagcataatgtctggcacctaataagtgctcaataaatatcagctactatgatttggttagttcttattagtacttaatctgtgatgtgcgcagagaggagaaataagattttaatataagaacgctagcaggctttcacatcttttgcaagccaatagagccttggggaaaggtttggcttctattagtttctccaatggctttaattatatataattacacagaagggataatgaatacttagttcatttccattagggtctcaacagagcttggtagttaagaccatgacctttggtgcaaaacagatttgggtgtgagcctggctctgtcactagttctatgattttgggtgagttactgaacctctctagcctcaatttactagtctataaaatgggaagactaataggattcatatcactgtgttcattggaggtaaagtatctggcataatgtttgctccatggagaatgccccaccaccaccacctcattatgttcatagatccttgtcaacggaggaatctctgtatttcctatactttacaaaaagacaattctgttgggtttgtcttttttcccacttaaaatggctgtgcaaagtattgtgaatatgttgtaaaacttcttactctgtacactaattacatcaccaaagaagggctctactcagctagaaaggagaagcttggattagaagaatggaagaaggggattttaatgcctttctaaggttactgaaggctctgaatattctaggatccttggagctgagggtaaggagtgcattatgaaaccctctttgccggatttatttctcttccttctctttgtctcctttctttctttccccttctcttctcttcccttttcttttgttagatggatatggagatggagacatagtgatctctcaccacccttgaaattgggccgtcccttttttttttttccccctttttttttctatagcagatgatcctaaaacacaaaagtacccatttgtttcttcctgcttattcattcttgcaacagaataacaggaggatagaggaaggcactatcaaaggcatttctgttcaaaagaaaaactcctcaatgatcactattactgttggaagctccttttgcttctttgacagcataatcacttttctctccttgatttttgcctgtatccctgaggcacctgaacatgagatagttttccctttttcaagatgtgtctgatgcacagaaagcagcagacgaagctcatgatggccctggggcatagctagggcagtggcaggccatgcacagctgggtctgtgttgtccctggtgggaggcatatcactactggagcacaggaggattttgggaggcccatggacaaagcatccaaaaaaccatcagatcacaaggtgagaagttattccctctccacttctctctccagcctcaagagcaggactctgtctggtgctagggtattttaacgcctctctaacacttactaatgtccctttgtaataaagtgagaaggcaagcctctgaacagggctttcagcaggcaatggtacccagctagaatttaataactttttttcatgatattcatgaaatatagcttctatatttatagcaagggatactggttttctatttgctgcagtaattatgagtttccttttcattgaacaatgtaagaaacataaaaattaaatgaaaacataataagtaaacaacataggtattatgtagatatgacaaaagtgttgaaggttgggaagactgaggaggactgaagtttgggaaaaccacccttggtacagtgacagaccttttcccttttgggcttacttccaaagtagatctaccttcccttgaagccagatgtctggatgcattagtttgtgagattctctatgaatgcacaaagacaagatctccacagggataaagagcgtgctagggaacattttagctttagtcttcagtctttaagtagctttatgagagaaagaggcccactaggttctttccataggagaaagttcagggcagcagggagatggggctttagagtttggttgacttgggttttcatctcagccagaaaggtaccattgtggactctggatttatatcatctggattcaaatgaaagctctgacacttactaactgggtaaccaagggaaagttacacatatttcatgctgtaattctcctatctgtaaaatgggataataatagaatttacttagagggttgttgtgaagattgaataagttaataatgtagactacctagaaaaaatgtctagaacataatctcatggtaagtgctcaataaatattaggtgctattattgtcattgtcatcatccaccaccaccaccaccactaccaccaccaccacgggtgacattctctctgagtctcatgttcctttgtttgtaaaatcagactggtactacctgcttcaaaatgtcattggtgcatgaggctgatgcacaataaatgccagctccctaccattcactttccctaaaaatgtgaaacttgtaaggtgatgcaaacttccaaagctatgggtctttagcctttgaaccttactgaattgtgaatgaagcaccacctcaatggggtttatgagtgctgaggcacctatacacacccatgcatggagtttctggcgatgcttgatatccagttgtgggagacatacatgaatgtcagttgttcaaaatggcacttttggcttttaaggaagttcattgaccaatcaagcccagcaaccgtaaccatagatccagctggagcatggatgagctccttttccctgaagatagatacattaaagtctttagcagctaagaccaattttaaacccatgctacttctctcggctgaagtgagcaccattttattaagttggtagtgagctgtagctgccccactttcttattgttcatctactattgatctaaactaatcacttaattagcccagacaagaaggcttctgcagtgttaaataactctaaaaacctactggaaatgcttgagtggcctgattggatttaacttgcagttcattacttttagactaagatatgttaaatacagggcctgaaaaacagctagattctgcattaagaacacattttatttacttaaaaaaaaatattcctttaggccagtggttttcaaagtgtgggccctgacccaccagtatccatgttacctgggaacttgtcagtccctggacccactgcagacctactgaatctgaaactctggaagtagggccttgcaatcagttttaacaagtatttaaatatcagtatcttggtgatactgatggaggcgtaggcatgagaaccactgctttagactgtctcacaaagttatggacttattttattctctctggcagcaagaagaaaaagaataaaggagaaaaaaagaaaaagggtgaggggcaagaaagaaaattagaaaagtgggagacctgagcaacctggataggaagttcatttactgaagtgtgaccctggaccagcagcacgggactcttttagaatctgggagcactatttgaaatccttccttaggaaccaggcatatcaaagggaggtgttcaccccaagccagggtgatgagacaaaatgctcagagagtgagcaaaatgctgctgtgctgtcagaaaatgagaggatagtgtgacatttgcagagtgaactaaagaatccaggaaagtcccattagctctccaaggccttccctgagatgggcacacagaagttatccagtaaatgctcattgaactgacacagattgagacttagtggcctaaactgcttcacctgcaaattctcatctgagaaagtaggtatgtttattgggcctggtctgtagggaaaaacaagagttagcccacaggacatctactgttctcactcttcctgccttctgaaaaacagcttggcatagggaaaagggcaaggagttcatatatagacaggcattcttatttgtgtctgacctgaagcaagttaccaactctttaagctttagtttccttgtctatagaaggagagtaacagttacttacagatgattttgctcagcactgagtaccagcacctagtacatatagtatttggcatacaataggtgttgcataaatatttgttaaataaaaaatttttaaagggaggaagaaaggaaggaaacatagaatttttaaagatttaaataatgctttgaaaattcttagcataatgactggtacacagatattcttcagtagtatccagtattatgatgaggaggatccaatgtgatgaggaagaatagatttagaaaaaaatcttctcagtgcctagaatagactctatattcttactgaaactaggcctgctcttcccattcctccacggttactctcttaacctgttcaggctgctataacaaaataccataaactaggtggcttataaacaacagaaaattatttctcacagttctggaggctgggaagcccaagatcatggcgccggcagattacttgtctggtgagcacctgtttcctggttcatagacagtgccttctcactgtgtcctcacatggtggaaggggcaaggccacttgctgaggctcttttttaagagactctgccatcatggtcttatcacttcccacaggcccttgctcctcttaacactctcattggtgattaggttttaacatggaattacggaggggagacaagcagaccttagcagtctctccactttccagttatgccttcagggctgcctcaccgctgttccatgcatagtaggtaataaagatattttcagggcctaagtgaactacatggatgtgacaatgattgagggttgttggtcgtagtcatagtcattccaggtaggaatgacccaggttttattctgataactaagaagttacatcttaattattttacattgttttatttccaggttaggtaatcattaaccctttgattaacacatttgctttagggtaaaagtaaacatgtttagaaacatctctccccgcccccaccaatatgttattatcgtatacaaatgccattatttgcactcacttacatgactaaagggaggttttcaccttgagaatatttggatatcccttgcttttctttaaccattcctccccctttgtctttgtacatcagcacaaaggagcaacttgccaactcaatagacttaggagagaaattgggaatggtaaatttgctgagagtccatggttaccagttcctcttcaaagaacatgggttttggggttacacccgagttcaaatctcacatccacccattaccaactttgttaccttgagcaagttactaaatctttctaggcataaattcccatgtacattgtatgaggatcttgtataaattaaatgacatcatttacaaatgtatctacagcaaatattcaacaaaagttcatttccttcttaccagcatgttgagcaaggacattcaacagatggagacacccagaagaaggaggtacatgcccagaccttagtctggaggttggattcagggaaggatgaatggtagaggtttctgttcagtaagacacatggctcctggtcatcatctgaaagaattggtgggggtttaaaagtattgttctatagctttgggtcaactgtgatgaaagcaatcatggaggaagatcctttaaacctccttgccaaaaatggaggatcattcttttccaccatgtggattttggtgacaggtataacaataaaaataggaatgagctgagagttggaaaagtgagaactcaaagataacgggagaatcttcttcggaatgtcatcagtacaaggagggagtagctgccatgctgtttctgtctaacacaacagacatgtgataatggaaatggatgttcatgcacacatccagttacccactgctcaccataaaattagcaacactccagcccctgtgcaaaagagaaacagagtagtgggtatttgtgtccaagaagaaatcagagagaagaaggattctgccagggacattgttctgaattaagcattggttttcattgcttttggtattttctccatgtagaccagacccactttagcaaacagagtcatcattggcttttcccatattggtatcattaggctttgtttagttcttgaaactgctacaggaaaggagtccccatccagacccgaagagagggttcttggatctcacacagtaaagaattcagggcgagtccataaagtgaaagcaattttattaggaaagtaaaggaataaagaatggttactccacagagcagccctgagggctgctggttgcccatttttatgggtatttcttgatgatatgctaaacaaggggtggattattcatgcctcccctttttagaccttatagggaaccttcctgacattgccatggcatttgtaaactgtcatggcactggtgggagttagcagtgaggacaaccagaggtcgccctcattaccatcttggctttggtgggttttagccggcttccttactgcaacctgtgtttatcagcaagatctttataacctgtatcttgtgccgacctccaatctcatcctgtaacttagagtgccttaaccgtctgggaatgcagcccagtaggtttcagcctcattttaccctatataataatgatctcctactcaagatggagttgctgtggttcacacacctctgaaaaaacatctcctaaaaggctctggaaacagttcgtgtttacaatggcctcatggggccagcatggaaatagagtgtttcaggctggccttccccacctgcagcctccacagcctccaaaccatgccagaattacaggaagagcctgaaatgagaaaacccatggattgacaggtaggaatgaaactctcccagcattttagttgcatagacaaaatggaagaaaaactgcaagtaggcttgcaatatgactcaactaactgttccacgtgaccaagcgttgattcatttcttcaattcaaagtcaaacagtgaaatgtggaattagccctgaaggcaggggccaggcattctggtgacatttgccattacaacctgagagaggttcagtgtttgacatcctgggtataagaataattgttacttttagggctgttctctggatcacaaatcagtaaccctctagcagagggaagattaccagtacttgccatcttctctcactggcattttctctactgagcacatcctgttcagactgcagtgctttttaccttcagctaagagcgaaacatcctagaccaggcttgggaactagagggctttccagtctcaaggaagcagcaacaatcattcccaataaacagggctttggcaaaggcatataataagattttaaacaagatgccgttgagttctactcagtctgttgtcttataccagatcaaaaccatcaaatgccaaatgcctgaagtcgctgtttcaatgttggctcccaaaaatgataagtctgcgtcaaatccctgaaatctgtgtatgtgacattatttggaaaaagggagtttgcagatgtaatgaagttaaagatattgagatcgtcagcctggattattcaagcgggccctgaatccaatgacaagtgttctgataagagtcacccagaggagagagacacagagcgaggaggaggaaagtgagatcagacagagaccagcaagattccaaggaacgccaaggatcatcagccaccagcagcagccaggaaagaggcatggaatgggtgctgccccagaacctctggagggagcatgaccttgctggattttggatttctggtctccaaaactgtgagagaataaatttccatttgtggtcatttgctatggcagacacaggaaactgatacaccacatgttggtgatggtactggggtctgggagtggcccataagcctaaagagattctcagagtctttgtgtgaaaaagaaaaatcctggttttgttctttgtagcagtgctatagatgtgttttattttcctgtgtaaactctaatccccacatttattaatataacagaggaaagaaagagcccactaccgtcatctttccttgaagaaattgactattgtgggcaaggggcttgcttcctaacactccttacactcctgccactcaaacagctcagtctgaaaggtcccatcactgcattacatgcttgttttgttcctgaagctgattttgccattttaagctcttgagctttgcttctctgcactgaaggcaggaagagaatataaccgaggaaaggttgtacatttcttgttctattatgttacctaccaaaatggaaactctaaatcttagcctcaacaaacctttggtttataggaagcacactagttctaagagatccacttcctgagttatgcctttcagagactgtaagatatcaatttttaggttagcacaggctaaatattttaactaccattttatttccatccaggccaagggacaatttaggaaaggttctattctgagtacatagccaaggaagtgtggaaaggctgttgatgccattgtttagaagttagcctgtcattcatcatgattgaaacataaccccaatggcttccacaagtgtaataaaacgctttgcaaaaggttgcagaattgcaggatgtaataaaatctgcttagcttcatttccaatgccgcagagttctagagaacgagacccatttccttatgccttgggatttgttcaagttactttcatgcctgaaaatgacggaacataaaaacagacatttagttagaatcaatagtatcttttgagtcatggcaataaataaaatataagtttgtttactgctaatcttttagattgccattagcattttacaagaggccctgttgatagggatgaattatataaaatagatggactgcagccctgctgatgcctgcagtcactctggattctcacatttcctgtggtctctggctactgcccttgtcaccagaggtcagtggcatggtctcttaagagtgtctgttatagacacaaatcttacctagaaacaagccaattcaggtctgtattaattaggtgaggacaggatcccaaacagccattgtcagaattgcctgctgaccacttgttaaaaacacagatttctgggctctgtctcctacatgatgacttagcaggtctggataaaggcccaggaatctgtgtttcttggcaggttctccacatctgagttgttcaacccctggatgttgaggtgctgtgcaggaggcagaatgagctttgcttcaaggccaagacaccttaaggtcaagtatcttaggccaggcctaaaacaatttccactcataaaatgggaacatagggagaaagtcctttaatcttatttggcaagaaaatgaggaaatcccttggtggtatagtggtatggtggcccagctccacatccaggagagcatgggaatgcatctcagggctctgccccctccacccccgttggagccttagcttccgggccttaatcattggtatcagtaaaatgagtgtggtgaggaactgggctagctgggactgctagtttggaggacattgaaagcagagtatcataggaaagagaaaattaaataggagggaaaaaaaatgaggacttcctgggttatattttataaaatttgtgaaagattgcaaaaagggtgctaggagatgtttggggtagctcctgaggactaagctctgattttttaaatcttgcccaaattcctcctatctaaggggtctggggagtcatgccctacaaaccacaaattctcatcagatgggttttatttaatcctatatattatgacttactttccagtatgactctggcataacattatgtgataaagaagaaaatcaaaatattttaccccaaaacatgtttctttgccatatcttgaaatggccctgtaaggccgtcctttgtggggggaaatgtgcatctgtaaagaatctctcttaacgtagctagatctttttattccaagccctcccaatcctgaggagattaactgagagtctagcatcttttaaaagtctgaataggaacatttgtcatctgttctaagggcagccactatgagactgagtctccacaatcttttatcttcacctgaacatttcctttctattaatcccaggtctttagacaaactcaaccagttgtcaaccagaaaatgtataaatttacctatagcctggaagcttccctcctcatcccccacaccaattgtcccgtctttttgaaccaaatgaatgtatttctcgaatgtattttgattgatgtctcatgcctccctaaaatgtatacaaccaagctacaccccaaccaccttgggcatatgttctcagggcctcctgagggctgtgtcttgggccatggtcactcatgtctggctcagaataaatcttttttaatattttagagagtttgactttttgttaacactaccgtgggtgtgatacatgaggagatttttgagaaacattgctgagaaacacaaatggacttctcctacgtcgttttcaagggatttcagtgaagatttaaatggcttttcacgtactgtttgctgtttgtagctttgagtgcagtgctacaggcacagacctgggaagctgagctgagaagacccagctccctgctcatttccattcagaacccaaggtgagtccattcaaccccaccttggtgaggacacaccagcacccacttcagcctgtggtatatggagatttttctgtgtctagtactacacttttcttacaaattagtaacaaagtcagaggtcaaaaggcaggagatccctttggaattctagtttatcccttctgggatccagaacacagaggccgaatcacttctgcttctaacctgcatcaggaggcctcatatctgagctcaggatcccttccctgcgggcccactgaggtctgtaagtgagggctggagagtggggtataggtaccagtcagtttgctgccccggacaaggggatctgtctcattcctatatggcgttgggatgatccactattgtgccagcaccatccaccttgtctggagatacaggtcatcttctgatcatttatcatggcccttgtccttgaataattattgactttgagtcagaagaacctgcgcaggcctgaaaatggatgtgccctttcttttcctctgtctcacttgtcttgggcagatttatgtcttaggagaagtttccctcggttctatttttggtcttctgaacactgtggccctgtgttccttcccaccctgactctgtccagcaccaactctgtaatttctgaatctctgtggatgcctctatccgtccctgaggaggcctctattagtctacttgcaatgcttctgtgactcctctgtcacagctttggcctggcttcttaaagctctgtcttcagccgtttcatttccccaactagcctggaagattatgggaagcagagtctgcctttcattctcaggtatactgggtgagcatggcagactttgaggagtgaaggtttgagtctgaagtccactgcatcatttaccagctgtgtgtctctaggcaatgtgaacacacctcgtgggggctgtggagagaactaggtgggttaatatacagacagcacttaaggccctgtctagcacattattatgctcactcaatgagagcctctgttattatcattatcatcactaattctttgtgttgcattgccagcaagactcatgagcgtcaaagcaagtgaaaagtcggtactcagtgacactgtgggattctacctcattactggaaagggtgcatctgggcagtgcatgtgtcttcccatcttctagttggattcctctcacaatgtgtccctcttcatatagctagtttccttccatattgcctttagaatagacagtggtgctgttcagtgttatctgggcatagcaacaaaaggatttactgaaatgcaattaagcctctgaggaggtacaaaaagggccctgaaaacaggtgaatggctatttcctcaaggtgcttccaacccattttgggaaatacttcacacagagtgaagcaaggtggtagataactaggggtcaggtgagcagtctagaatatgtgggcttctggagttcaggggacaaagagggcaggagcccagaatgccaaaagtttgatctctatgaacatgtatgcttttcaattttcaattatttctaagttcctaatcaacatagtagcagattacctgccccttacctccagccctaaaagcatgcttgagaaatagtaggtagcgagtactgtgaaactcattataaggggtttgttttgtagagtggtgaatgacggcagaaggggagctctgttgctgtggacagtagaggagatttttggagacggcagctttgaatttggaagaaaaatgaaaatgtctgttagaggaacttgaggttttgtgtaagatttgctgagggttgtgggctgtaactttctcatccatctctgcctgaaacctacaggaaagtctttgaggttggctagtgttttattgtatgacttagtgggcacagagtgaaagcagaagtatcaaaggggtcccagcttgcgtccgaagtgaaccaccctgacttctccttgaacgtgtgggtgtcatcaggcccagtcttgtctttccccaccacctctgtgtgcattcaaggcaacactcacctttttaccaagcgtgtaggtgaagaaggctcccacctgttactcctttcccctagactttcacagacctagaggaagacagcctcttctgctttgaagctaagaaaatagatgaatgtctgtgtcttctgtgggtgaacctggatgggagctgcctatagtcaatctaacttgttagggtgaaaaaggaagggttgacaccacaaaaactcagcaggcctccgccttcctcttgtttctttaaggtagtgtttctcaacttggctgctcattggaatcacctgggaaggtaaaaaaaccaaaatgctatgctgccatcctgcccccagagcttctcagctaactggtctggagcgtggcctgcgcctctggaggggaatcattgactgtgagggtgatgagctgcaagcctgcctccactttgactctggtacaaaatatgctcccaatacattgccccaagtgcgccgaagcaattcagatgcagtaggtttcagttgcaaatattcaacttgactaaggttgtctgtttttagtactcatagcagaaccatgtgaataggacagttgtcctttgaggatgttgctccttgcccacgaggattaataaaatggcctgctttgattctatgcaaggattgacacagacatggttttaaaatgaagtaaccacacttaccaataaatcagtctggagacacaaacataaaactcctctttaacaactctcttcttttaaagtacctgttgttcattcctagcaggctagagatacaggctgaggcagccacagaaagtcattctgctcacaccaaaaacaaggtgagcaattttccaagggcaggcacccctgacctctgcttttcagctttttcttaataaactggtctcagaaattggaccacagaagctgctggcggcaatctcttctagtaagtgggtaaagggaagctgagggagaaatggcaagggtcagagagccactctgatgagtatctctgaggtgatgcaattatacttccatctagagataggaaggggttacccccaagtgcagcagccccaaacccagcagtgtgaagttggacttaggagaacagagcgactgcccagtgagctttgtaactcaaaactattcctccatggcacgttgtacatgttcatgaataacacaacttcctgcagtgagaaagtgtgaattcctgttaagcagggtctgttttccaatccactgtgcttgcctccttgagggcacagaatggataaaacagccccacacaccatgtggccagtcccctcaagaggagaggtgcagacagacatctgttttgcagtgaggtggaggttcactggtaactgtggtttatagagcgaccacagactcagccttgtcagttttccctttgaagggataaactcaacatgaagaacagcaaacgcaagaaagatgatcccaaagcttgtgcttgggagtgagtgaccgcagcctgcagggcttaccatctcctggcaaatgaaactgcttatacttaggtgcagaaccaggcaaatccacccttagaaaacttccactaccactggggcattcctttgctgcccacttgaagccagcaaggcttctgtcttctgtgtttgctccatttacatccacttccccgtgcctgtgcatagccaggacgcccctctcaacaactttctcctcccgatggggcttatgaaagacgggctttatttgtcttaaaatcttcagctgatattgctcttctctacaacacagttgaaatgaaaaaggattactttatatttacttgcatttttcgtgagaaaaactaattttgagaaagaaagtccctacagtgtgaaacagtttcccttccttcaaaccctctgaagaggcaaaggcaaacctaaaaggcatacatgctttgtcattgactttctctgacagctgcttcttatcatgtttttgagggtgaccttcgtccagcatattccttagctgtaagttgcactctccttttataatcgaatttagagccaagcatggaccaggctacctttgataattaatggctctgtgagtttgctgagtgtgttatttaattaatggcgcttgtgtttggagtgtgtacaactctgtagctgaataaaaggcttatttgctgaattattacagacatatacccaaggattgtcacactgagaatttgtcggggttcgacacatttaacagcctaatggggttattttttttcttttccaccatttaaaggtactgaatgggtataactctgttcttttgccttttatataagctcatactaccatctgagaaaatctgtaggctaatggataaaagtctattacctggagcaggacctttgagaaaaacaaaaagatgaaacctttaatactatattttgagtatgaaattgatgttcaaataagttatagtctacttcagttcctcataaataggttaacttgaattatgttcaagttctacttgggatcaaaagatcacgggttgaaacctggcaagaaaacacggttgaaagctagtaagaacacagagtatctcacgtgaccttgcttttcctgagactccagtcccagaataaaatgcgtattgcggcaagacagatatgcacatatacaaatgccttctaaatatcctgtatggaagcatcaacaggtgaatctctatggactcatctctatgtgttcagtaagagactgaaaatataaaaggtctggttttaagctgtgtcgtttctaggctttgtcattctgtgtgtctgggcaagttttataccctctctgggctatagtttgtttctttgcaaagcaataggttgaaccatgtgctctttaaactcctttccaacccaaagagactcaaagtctctaatttttccaaagagggatacaaagtccactatcccagtgatagaagagttagttgattgcttactttggcgacctgaggttcattttttcccagaagggacctttgagtatgggaaaagccatatccatatgccctgcaagagggctaggaggctagtccattctctaaagcccagccgtatggtccaggagacaagaactacagccagggacctgctttcttccatcccactggagacccccactgacggaaaacactggttaaagcatagaaggaaaaaaaagcactattgtagactgggtacttaaggaaggcctttctgagcaggtgacatttcagtcaaatcctgaatggaagaaggaaagaagggaggacgctccaggcatcaggggactagaagtgcaagggccctgagatgggcctagtttgacattcttcagtaacatcaaggtagcgggaaggctggaactgagagcctgaagggttgccataggagatgagactgggcttgattctaagtcctttactgtgctgtgcaaggcctcatgtaatcaggccctggctgactctccaaagtgtagaagagaagcatgatctggcttccattcaaaaggattgtgattttaacccattttctattttaatgtgttcattctcttgtatgaccttgggtgagtttgagggtatagatacatattttaagagtcacagtcaacagctgatgtataatattctatataagttatatttttaactgcaatatcataaagtcttgcccagaaccaagagttactaggttttgctgaaaatgtttttcttttacattgttgtactacttttactttccattgagtctttttcttcaaaacgattaaagaaattaaaactaaccacatacaagatctcccactttaaaatttaaaaagtgccctgatagatagattttttgagaggagagtaatagaacaaaactttgataggggtatccaagagaaatgctgattcactacattaggtatatttctttttccaaactcatgactccagaatctgcaggaaccacaagagattggatgagaagctgggggcagagttctaacagcagcccaagcctccacagtgccaagatgggccatctgcctgtgagaagggaaagcttccacttctcttagcaatgactctggcttatttctaatttagcagaaaaaaaaaaatgattcaagcaatatcatgtgcttctatatcttcaaagcaataccacaccatcaattagcagctcagcgtaccaacagttctaaactttttgcgagcttcttggaaacaagatgtggagcttcagcagaagaaaattggtaagaacatctaattacattaaaagtcatttttgcctgtcttaaaggaatgaaaatgatctgccggtttttatagaccttcttgacccaaagatatctgctggcagaaagagaatcctcaattgggttcttttaatgctttaattattacatgatctatcatcttacgcactgacttgtacactttgaaaaatcctttaaatacggattaaaattgattggctaatcccagaccttagggtggagcttggagggcatgtaattgtgtgtgtgggctcagggggttagacaggaatgacacagagtcaactacttcatagtgggataaggtgagaaatcaatttggtcacaggtacagttgacattgtactgccaacttgcacagaactcagtcacacgcccacttgttcttgaatcagtatgattgcttcaacttcaccatcggctcctacaaggcagggatgaacttcacctagtgtgcctacagtgtttggcatctcctgccttaaacttctccaaatgatgagcaagatgacttataggaacttcaaatctacctcaccccagtcaagggcttctctctatgttcatagactaaatggtagggaagaattctgattggatgagctggagtcacatgcccagaactgtaggttttggatgggattgacagctccaaattcaaatgtctactacactccatcctgtactctgcttggatctctcgacaatttttcaaatgttttggaatctaagagctaactgcaaactcttggtggaaagccctatctctagagcatgtgctcactgaaaggtcttgcatgaagcccttgagagtcctcactgatcccaagagtgcagtatctaatgcgttacagtccaaggttgattagccgtgattcactcctgctcatggaatgcagtttcagctttcagacacatactcagtctgtaactgttgctgcataaggaaacaagggatagctctgtttcctaaagggttaggaataaggactaggcactacccagctctcataaccacttctagcaggtggttgtgacagctggataaagtgatccaaagcacaagaatcatcaaatgctggctcttttcctgaagttagtgcagaagctagagtaaggtataccttgcaccccagctgcaatggacaattcttgcctttggttagctagagcttatgtgagggatgatgtttctaaacagagagccaccatttttagtgaaaaggtaagtgtgggctccagaggcagactgcctggacttgaaccctgactcacaaagtataacctgagagaccttggggcaggcaagtcacacagctgctgtaagcctcaattttcacatctgaaaaccagggcaatactggagggttgttgtggggtttaattgagtaaagtctgtaaagtgcttggtataacttgcccatggtaagctcgtcaaaagtggttttattaagaattattaataatatagcctcttctctgtggtgatctccattgctcacttcctgaaataacgatttgtttggccagagtggcctcttcaagtcagggaggatggtcaggaagaggagtgccacctccctgatgtactggtagtgtgtctgtaaagattatacacagcaattactctttttttgtttaagcctgttatgaaatacttgaatattcagccagcaacaacatgtcaatctctttcttttcttcctttttttttttttttttttgcctaactgaaaaattttcatttatctgatgtgctagtccttttgatggtgaaatataacacacatacagaaacatgcaggaaatatgtacatggcttacagaattaatataaagccaacacatgtcttgccaacacccatggcgaggaacagaacatcgccaacccttccactttcccaccccactcactccacgttccctttccaaatcacggttcccttctttcttcccccgcaaaggtaaccacgggcctgactttcatggtgagtgcttccttgctttccttataattttaccttctaaatgaatgtatctctaagcactgtaattgaattttgcctgtttttgaactttatgtaaatgaaatcacacagtatgtgttcttttgggtgtttctattgttccatattcttgcaaacacttgatattgtcagtccttttacattgtgactattctcgtgggtgtgtagtggtactttactgtgttttaagcttatatttatttccctgatgactaaagattattggccatttcaatatccatttttttgtgaagtgcctgttcaagtcattgtgtattttctatcgggctgctgacttcttattaaatataatgtgtttttctttgcttcctttttcattttatattgtcttctggacactagtcctttgttgattatatatgtggcaagtactttcccctccaccgcagcttgtctcctctctctctcaatggtgtattttgacaaacagaagttcttaatttgaatgtagtccaatatatcaatcttttttttcagtagtgccttttgtgtcctgttgcaaaagtctttccctatagcaagattatgaagatatcctcttataatatcttcaaagcctttaaaattttacacttcatgctttgaactacaatctacctggaactctcttttgcatgtggtgtgaggtagggtttcttttcattagttttctacatgggtatccaattttccaagaactatctattgaaaaaaatcttccttttctcatggctctgtagtgtcatttttatcataaatcaagtgttcatatatgcctggatttgcttctatgtcctctgttttgttctatcagtctatttatctttgtaccaataccatgctctcttaactcttatagccttgtaataagtcttgatatcctgtagagtgagcccctccaatccttctaatcttgttttttctaagtctctggctacatttccatacgcattttagaatcaacttgtcgatttttaccaaaacctatgggaatttggaactgagttgctgtgggtttatagtcaacttgaggaaaattcaatctttatattaataaaattgagtcatttacttctccatttatttaatttctctttaatgacttaatattttacattttttgtctataagcttacatacctgtaattattcctaggtatctgatttttgatgttaaaagcaaactttaaaacttttcattttctaaccattgtagctgatacagagaaatttaaaacatatatacacacacacacacacacacacacacacacacacacacacaccccttagattcagaggccttgctaagtttactgattaattctacttgtttctctatagattcttttgggttttctgcatatatcatattgtctacaaataatgacagttttattcctttatttctaatccttctacaccttttgtttattgttctcacctttctacactagctaggacttcaaggacattgtgaaatagaagcgttaatagtgaatatcttatctcatttacaatctcagatgcatagtgttcatttcattcctgagtataaagtcccttccacttgtagctttcctagaccttttgaatttaagttagatgtgtaatttgatcaataattttatttgcatctactaagacgatcctatcattttctcctttattaacccagggaaagacatcatttgaaagtctaatgtgaaaacaaagttgtattagtcatgatgtcttatccttttcccaaatcgtatatgtgcgtgcatgtacaatctgtctgtcatctgtctgatatctcttagaattttgacatttgtgtttccaagtgcaattagtctatagatttccattctgtaatgttcttgcaatgttcatttgtaacataaatcatacaacaaactggacaattaaagagtttcttttccccccccttctctttggcagaatttgaatgagattcttatttgtttctcaagtacgtggtagaattcaccagtaaagctatctgggcctgaaaatttctttgtgggaaggattttatttcagactcagttttctttaattagaatccaattttattcatattttctttttcaccttgtgtcagtttgtgctagttgtatttttgagaagcttgtctatttaattcaaattttcaaatgtattgctctaacattcctttttaatgactatagtatctatacagaagtttgcctttttctttttaacatgggtttttgtttcttcactcttttcaaagaccctacatttggcttcattgatcctttcaattgcatttgtgttttctattttattacattatgatttattgttatttcctccctcttaattttgtggttctctttttaacttctccagaaagatgtttagcacattaacttactttttttatttttttaattttaattcttaatttttgtgggttcatagtaggtgaatatatttatgggatgcatgagatgttttgatgcaggcacgcaatgtgaaataagcacatcatagagaatggggtagcacagtaactgttgacttttcttgaataagggcattcaagtcataattaaaactaaattaccctctaaacacacctttagttgcatccccaagtatgagttttcttcagtcagttcaaaatagtttccaacttccacttgatttcttctttagtgcagtggtacaatcttggctcactgtagcctcgacctcccaggctcaagccatcctcccgcttcagccccacaagtcgctgggactacaggtgcataccaccatggctggataatttttgtatttttaatagagacaggattttgccatgttgcccaggctggtcttgaactcctgagctcaggcaatccacctgcctcagcctcccaaagtgctgggattacaggtgtcagccatcacacctggcccttagaattcttttagtgtaagtctattggtgacagattctcagctttcatcagaaaatgcatgtatcttaccttcattcatgaagtcattcattcattcatattaactgggtatggaaatctaactcagtagttcttttggctctcagacatatcctgtggtcttctgattttcatttttttgtagttgttgtttttggtctaattatgacttctttgaaaagccagtgatttttttccttcttaagtctgagtttctctttgtttttgcttttctgcaattttattgtaatgtgtctaagcatggaatcttcactgatgctttgattttgctgtgtttcggatttttggattggtagcttttcctggttctgaaaaattgtcagccatcgtctctttaaatctagattccactgaaactctgttttctctccccatggaaatatgaataaatatctttcaactttctccctgtattttgtcttctgtcctcttttctactttttcctctactctacctcttcatgtttcagtctggtattttcatatggctcatctttgaattcactaattctctttctggctgtgaataatgtgttgctaaattcattcgagttctagaatttttatttggttatttttctcatgatctgtgtcttttctttgtaataaattctagctctctgctaaacttaaaaaacaatcttgtcttttctctccataaataaacatagttaatttaacatctatgtctgataattccaatttccaggtaacctgtggttctgatcttgtttgtatcaatttccgtcttaagcagcttgagctgctatgacaaaatatcatagactgggtagcttaaacaatagaaacttatttctcatagtcctggaagctgggaactccaacatcaaggtgccagcaaggtcggttcattctgaggcctctcctcttggcttgtggatgggccaccatcttgctgtgtgctcacgtgaccccttctttgaatatgcataaagatagaaatctgatgtcttttcttatcattgcacctactccaccctgagggccccacccttgcgaccttatctaaatctacttacctcctgaaagcctacctcctaataccatcacatgggggttagggcttaaatgaattgtggaaggacacaacattcagtccacaacaacttgtctcatcacaggccttctgtgtttgtgtgtgtggggagggcactgtggcattgggggggacaaacattcacacatatactgagcattctgtttggaaacaaatgtgagaaataatttcaggtcttggttggtattactttcttccagagaggattttctggcttctgccaggagtttaatggactagcaatttgagatcaccttaattcaatttccagtcatgagtttctcacctgcccagatgatttgaagttgggctgtagttggtgtaagggctcactcttattccaagggtataactctcccagatctttgaattcccacccagaggtggaggtttagcaaggaatctaccattggaaaactgactattgctttatctccacttgcctctctgaggctcacaaatgcccttaatggaaaagcaacctcaaacatggggctcacttctatggatttctgtcttccttggctcttggtcctataatcttttgctaccttcctacttctaacagatttttagaaagttctgtgtagtctttctagttgaacacagtgggaggattgagtcaaattatttggcctttagtaacaaaagcagaagacacactttttttttttttttttttttttttttttagtggtctgaaaacctcctgccctacagatttaattctttagttactgcttgaactaatttctcattacctgaatatccctataatttatcatcttcaaaatatactagaaatcagaaaaaaataatgtatttatactattgacatactggtttcccattccattattttgtgttttccttataataaccctgggatataagtaaaatgctttctctatcattataattcagagattaggaaattgagcacaaaagagcgacacgtccaggttcagagagtaagtgtagtggcaaacgttggtggggttccactttaaattatttaaagatatttgcactgagagtagaaaccaaactgacaagacaattcagatgccattcttaggagactgcagagtgtctttttatactttcagtcggtggtgtatatgcctggtgcttaggacaggggattggaaaacaggtttcttgttgggagagagagaggcgctgggacataattttcaccaaactgtaatgttcattttatcagtcttttgtttttaaagcacattttaaaaagttctgtgtaaaacacaagacaaacatttgctctggaggacacattacctgccacttgactttttcttttgattcggtatcatttacatgaagctctagtacagggggtaaccccatgatagggttgtaaaatccagtgcagtgagggctggggagataaaagaggaggtggcagacattcgtcccctgaaggagttgggtataagacaggaaaagtttattcccaggatggcttccttagcactctcttcccctgtctttgtatggttcctgacctctccaaaaatcatgttctgcctcaattatctgtgtaggcgaaaagaaggaaaaacaggtttctggaggaagaagaagtggcacacacatacatttagtctggggtgtaattttaccccacttacaccactgggacaagtggtgacattttaattaacaagatgttccctacttagctctatcctctcttttcctcattgttgggaggactttagtttaatacataagacactcacagtctcaattgcccaccactcatgatgaatttgaggtggtagagtacactgaactgcttcttagataatcagagaagtattaaagccagaaggagcacaatctagagctgactttgctagtgtaccctgtattgatgatcccggttaagtatgtacataatacttgattgatgccccagcgtgtcaaaataatggagcatttattatgtaagaagtggctgagggacattttaggcacaggaccaaatgaattgcataaatattagctattatgaagcagtggggtcaaaggttataaatgtgaattttcatagcctttcttcatattaaccttccacactgtctagaagagtcttcattctcaccctcctttcaggcagagacagacaaaaaggcaacactgaaaggagcacactatggagagtggagagaagcaagtacaaaaagaaaagaaatgtcttaggagaagaaagatttagaaagtttttgctatataagagtatgcagattaatatgcagttatccattgctggagatgaggataaaaatgatgagggtgacaatgacaagctttattttattgtattacaatttgatggtattaccattttgcaagatgtaagtaagtaaagcctgaaactcttaaaaaattatctttggctatttagattatacttttctgaaaaggactctgtggtaatgaatcatgtggtttcaagattcacatgcgttaaaattacttcaggacactagtcatttttcaattaccagtagaagtaaatctcaaaggaagagttctgcagattcttgagccatcaatggcctgtaggaaatcttttgaacaactgggtacatgttggagaaagtagggtcttgttaaaacattttaaaaataactaaactaagccaaaaatccattttggatccatggggtagactgtctcatagaatgtttctaaaaggaggtttttaaagtgttgttggatggtccctcttttgagttgctggaacataaatcatttgagacatttgatttgatggtttataaagtttccatgactctgtggtttattattcccaatttaggcacagggagttggtttatatttatctaatccaggtaatagagtatttaatttcctgtcactaaaaccagattctagaaatgtaatcatctaaatagaatgagaggagaggcagccagatccaacagaaattggactggagaagaaggggaaaaaaaaacaactgaaatctcccttctggcttcttttaaaacaatgggtcctttgtcaggcaaagagctttttgaacacactaagatatctttagccttaaaagaagtatcttctcttgtacctgtagcctaaagaaaatctattttcataacaatctgggaacggctgaaagagtttcataattgttctgaaacttggggatggctgaaacatttacattggtactgagctcctcacatggggtttatctagtgggtttaagattaaattggtgatgaagctgaatttaaaatccacctttcccccaagaaaatatgagagtactatgatcagcttcctgggcctttctcattagaggcttctgtgctgacagtggaacatctctgaggtggttgagatttggggtagatttcaaaaggtacaatttacagaccagaacatgtgctaaataggcaaacctgtcctttctcaatcaccttgactatccacaattatgatataagggtgatccagtggcagaaattatggtgatttttcaaaaacgccagtgttgaaattttgccttgacagtacatctataactactaataatgctgtattgggctgactcagttgctttgaaattgcatggtcccattatgagtaaatgagaggcaaccaattatctataaaataacgacgtgcacagagaagagcttgatgaattacaagtgagctctgctgacacaacagggtgtggaaacctgccctgctctgactttccatcagaattaggggtgatgcttgcatattttaacaacatatccccctcaattctaatgtggaatgggagaggggaggatggggagatggcaaaatcttcccccctagtcactaggacacatgccattgctttaaaattaagtagaaaaactgcttgggtgtatagtggcagcaaatccaagtatcaatacctgcataaagaattaccatcctccaggaagaaggcaacattagataagaaatgcaggtctcctgtcatctaatgtgatttagaacatagactaaaagagccattgcaaatcccttgtcccggaactcagtccagtgtgtagggagcaaatgcataaattcacctatgcagagagcagacgctgaattcctggaacgaaaggattgccagcctcatcaaggatctgtcacatggtgagtgagacaactgcagcttcattcagcaacccttgggctgttgagctccttgtgcatggtgaaggcaataaccctttctcactactgctcaagaaactgcaattcaaagtcattttctggtaggcaaaggatacagagagaagctaaaacaccaaaatgcaggtgcatataaccctggagggttatatgggaagataaagagagttcttttacacaattaatctgatgttggtgtcttgatggcttcaagaggctgaggagtcagtacatagtttcagaatgtttacctttgttgtcctaatggtactcttgctatgctgaggattaattctttatatgtaaggaagatatagaaataatacttaccaaggagttgctaggtgtattagtttgttctcatgctgctaataaccacacactcaagactgggtaatttataaaggaatgaggtttaatggactcgcaatcatggaggaaggcaaaagaggagcaaagccacatcttacatggcagcaggcaagacagcgtattcaggggaaatgtcctttataaaaccatcactatcaatcatgagaacagcatgggaaagaccctcccccttgattcagttacctcccactgggtccctcccatgacatgtggggattatgggagctacaattcaagatgagatgtgggtggggaaacagccaaatcgtataactaggtatgtccaccccaaacattaagtcaagaacatctttttggtcttatagtctttattcttatatagggcatctctggatataggtgttcacattcttctttgcaacctgttggttttcaagacagactgtcggcaagcaaaatgtcagaggcaagcactgagatttgacccatcagccctagggaagctgactctttggttttcccccatgcaccttgtcttcttgatatgcctgcaggggttggggggaggtgggtgggtggaaaggagtactggtttagggttgaagcaagtctaaagccagcttgctctgggtttaagatctggcctccactgctgtttctccaaagttgggagtcagtcatattcctgtttaagataatcttaagtgatctacattgaatctctcagtaggttattctctttaatccttctgaatatgccaaatggagagtttcggtttggtgctagaattaaatgcccctctaatggtggctagcctcactttttaacacagagactgaatctcactcctagttgctaaggcaagcaactatgcagagctggaaatcatcagcattgtttttctcttatgtttatttttatgcttaacttctaattacaggtagtacttgtttttctttgaggctgaaatataaagtttaagatatatatactaaaattcaaaaagtgaatcaagtaaataatgctctaggtggtccacaaagataagaaaaatcatgacaaaatgggaatgaatgcaatttggggaacactgtattcgcccaagtgatgtttatttaggcatgtggtcagatggtaaagaaaagaaagtgggagggtagcctaggcaggattcagcatgatctgagaatcttgcaagtagaaccaagttggttggggaaatccaggcccattttggtttctgctacctggctgtagtgtgaccagggaggcaggtgctgggcagggttgtattaacaaggcaggtaaggaagaagtccagcaggcgaggaggtgggaggtcctcaaggcagaaataggccagtagataaggtgaagaggctaagaagactatttggagggtacaaggggagatgggacagggagaaggaagtggctagagaggtgagctcttttagcaaggagggcagtacacagactaagagaatggcctttagggtgggactgcctggattcaaatctgagctttgccacttaccgttggccttgaactaataatacttaacatccttaagccttagttttctcatcacttgcaagacaggataataacagggtctacatcttataaattcttagcaagtgtgttggctagtgttatcaattccagggctgagccctatcatgtctgcctctgtgcatgttgagaattgtgcagttttgcagagtgagcaccatgaatgtctttaaacttgctctgcctaagactagcttgctgctgagggaataatcacgaaagctggagaaggccaagtctatctgaccttcagattaacaatttttaaagtctagctatgtccaaatatttcataattgccctatttactaacacatttcaggggtttcatgaaccacttaatgtataaaaattcaatatgtagacattttttttgaaaagggaagaaataagcaggtggaccaatccaacgattgaatttcctttaaaaaagtaactgtaactgtaataggtttgttgcctaattcatggcaagtcaatacaccgagacacagggttgcagcagagaaggaagtttaatcataaggctgccgaataaggagacagggggaaacctcaaatctgcctgtctgagccgtttaggtctaggtattttaagggagttggagtgaccgaggtgggggatcactggttgaagaatacaggatggtgagatgaagaaactgcattttcatgctgattcagttcctcttggggagaggcggggggcggtcttcaaactggttggcaatagctcttttgctggaattcaggatctgaaaaacatcttaagccatttttaaacaaacaaaggccttatgattctaacatcagaaatcttctctgtaggaacaatgaggaggcaaatggttagcatctggtgctctgggacttttggttacgaagaagtgggccaaagtgcagcctgattaatgcttaattacaactatatttctgtccagaacccagcatctaattcttgttaaccctgtgaggatggtttcaatagaatgtttccattgtccttaaagggaggtatagttagtcccattatactccaggtaatgatgacagtcttggcaaaatcttaggaccctaagttgtttgccacctcacaacctatattatccgtcctagtcttagttaccacatctgactgctgggaagactgagggtgatttgtttggtctgtgcacaaaacctttaaagagaaatacacatgttagttaacttaaaaatccacaggtactgtggcaatagtttgtgtaacaagttagggtaaatatctttctggtaagatgtacaagggaagtcaatttacctggaagacaggaggtgtcaggcctccaggcaagacagaagcaaaaactgacaaaacaaagcctacaggaaatttgggtaataagtttgaatcttcttaaagttcttaaagtgtctagaaaaagcattctaagacaaaactcctacaattcagcaagccttgggaaaaaggctaaagctttctagcctctacctgaaaatacccactgcatagaaaacccaggagaaaaaattcaacctaggcagtcaagtctgaggtattgtcaccccatttaaatttgaacagggcactctaaaatgacatactggccttcataagaggaacagaaagaggtttgtagtcatgcccataggcctatgttcttaggtaaactaaactagcttgatccttaaaaaacgagagagagatggtgaacagtggaaaaggttcaaaataaaatatgaaagacagcctctgttatagcacttgccatatccccccaggcaactgagtgcagagctgacaaacttatgacatgggagaatgaaataagctttctagaatgcaaggatctgagtacaacaccatatttgaacaacaatagggggcaaggtagtctgggtctttaactatttagaatactctaaaaagagggctggggagagaaaggccaagtgcacatatatttaaagctatccagtaaagacttacttacatttcaaggtgaaatcagaatacaatgaatgtgttttctagctaaaaatcatgatcactaagtggttgatacaattttttccaatcaattgctaacagcatttattcactaattttgttttttatttgtgtctgatctacttctgcaacttataacatgaacatatttattcacaggtcagatgaagaattgcctaattttaatttggaattatctaattctaaaaacaaaaaagaaactatttataggagaggatctgtaactggggtccatgggagtttattaacaggtttgccagaaaaaaatacaagataccagttaaatttgaatttcagataaacaagtaatttttttagtctagatatatgccagtattgcatggtaaccctatatttataaacaaatttcagagagatagatacatttctctctctctctctcctgtttttttgaaactgagtcttgctctgtcacccaggctggaatgcagtggcatgatctcagctcactgcaacctctgcctcccaggttcaagcagttctcctgcctcagcttcccaagtagttgggattataggcatgagccactgtacctggccttctttaacactttttgtttacaggccaaacatcaccctcagtcattccagcagtctactatgtgaactgagactaggagggataatatagattgccagatagatctaggcatgagctcgttagacactgcataaaaatttggagtagaagcattttgacaaggaaattggctatagctatctttctaccagagtcttaaacctatgatctctcaacagttagtcatcattaagacaaagattaattctatcaagccttgacttttccctgtggcctgagcttcctaggagccgaacataaagggaaacatgaagggcaatttaccaaatagcaactgaagagaagagtccactcagtgaaagcagaggagtttgcccgggggcgtgttagggaggcagagaaagctggtttacagggctttgcagacagacttgagcctaagggccatgtcacacctttaagttaagttggggttgaccttttaaacaagaagttgtgcatgacagaaggtctgctttgtgaacattggattctggaggagcaccaccgcaggaaagactggagaaaggtggtggtgggctgggggcactggcttggaagaagagagtgaagaggcaggagagttggaagagactgggaggctgggaatacagtactcaagggccagggttttctcccctccagctctttgtcctttgcagccaccacccaaggatgctggtgaaggtgtttttgtgcatccccattctgagagtgcagcctctttcctgaggcccacgggagggtctgggtaatgacgaaatgcagtctttacctgtgtcactgaaagtagacccgcagagctgcggcttctgctgccatttcctcctctgatctccaagaggcaggaaagtcctccttgtcatgtttctggagctttggagaaaaaaaaaggaagaggctctttcatgggcccttgggatctccttgaacaaatttcggggggctgggggagactgaacaaaatttgcaaattagaggccagtaggtgtatcttttaattgtttcagttgctacaacttgcaaataggctttatacaagaatccacatttaaaataatcagatcatttgccatcttgtaatcatctactgaggctgaggggggtgatgatatgatataggtctgtgtccttgcccatatctcatgtcaaattagaatccccagtgtcagaggtggggcctggtggcaagtgactggaccatcaaggcagaattccccattggtgctgttctcatgatagtgagttattgggggaccttattgtttaaaagtgtgtagcacctccctccactctctcttcctcctgctccagccacagaagacgtgcctgctttcccttccgccatgattgaaaggttcctgaggcctccccaaccatgctttctgtacagcctgagaaaccaggagccaattaaactgctgttccttataaattacccagccccgggtagttccttatagcactgtaagaatggactaatacaggtgatcacagattgggatgaagtgggggaatggggagcatttgccattcccagaatctcccccacactcttctaattttcttatgtttaacaggcatcattcatttattttacttcctggattttgaaggcattgagtttgccaccaacccataatcccctccttcaaggtggcctgtggtttacctcctactctctttggtttagactctcttgcatgagctctgagcagttttgttcagtgaaccaaatttatgataatgacacaagggccatgagaactgagtaagtaataagtatttccattaaaagagggttcaagcagggaaacagtaaaaaagagattaaatgagaaaacaacttacaaaaaattaacaatttgtctcaaaattaacacttgaatcatttaaattcctcctcagattacaggcatatttaaaaaattgtgtgtatgtctcagatttacatatagagtgaatacaatttcaattctatcagagaggatgttctcagaactctcttccttagaaatgctcaattttctcccttaacctcctattatgattcaatttcattaactaaatttattgttcctgtgtgtggctctatacattgtaaaatgccgcaggttatccgttcattcttcatgggaatgcacagtgtagtattttgtgttatgtgttaaaagtcatttgggattgagacaatttaatagcaccaatgatagctagcatttatgatgtgaaaggcgcacattatttctttgatatacattatttcgtttaatccttacaataactcataaaactgacgctacttaaccccatgttactgtggaggaaactgagttctgaggaagttcataccccggtccaaagatcacccagctaggtagtggggtaggtgccagtattatccccaacaacttttgcctttttattcatcctgagggatctacagtgtccctaaagagcatcccacagatactgttccactccattttgaaaaaggtcaacttaacgattaaaatatcgactttttaaaagttgatcctttaaaaataattttgccaactcagcaaaaagtctatcaactaataaatgacttttgctatctcaggccccaaactctaaatctaacctagaggcctctaccctggcagcttgcagcagatggagaaatttccccatttattgcagctcaacattgatacagaaggcaaaacagtgagggaaccatagcctcgcactcccgctgagctgtatttccactcctggtaagtaagtttgagcctaaatgaggctcattagcatataaccgggccacagatacatttatgagggtcatggatcttcccttcagaatttggctgccagcacgctgattttacattttgccatgtagatttaattctccttagtgaaagaaaaccacattaagaagtcatttcctttcttgcagaggcaaacatgctgcagttgctacaggcaaggcaaacgggattgctattcttctactcaagaactaattttcattttgatactaccttgacgtctgttataaatccatcttatcttataacaattcaataggatgacaaagagatatgcaaagcccaggaaatatggccttcccacttctgctactgccattggaagacacagaaataaagcattaagtggcctcaacaacacagatcataccagaggaatccaaataatttagagcctgtgaatgttaatgccttcctggttattaggcaaccgtctgttattgtcatatgccttacagatggcaacattgtgccaatccttagaagaagtttttgggaaataataggaaataaataaaacaaaaactaatcatctttgcaaaaactctgttgtacctagcttttaaaagttatgagatttccctcctaaaagccccagatggaagcatgtggttctgtttagaacagcggcactcaaccctggttggttgcccactgtaatcatctaggaagctttaaaaaataaaacccaccccagggattctgatttaattggtctggggcagcctgggtttggggatttaaaacaaaacttctcagccaattctaaggtgcacttactgttgagaatcactgctttttgggagaagtgtgtagatagagcccacacacatatagaaagaatccgcttgcctttaagcacattgcttgtgatcctatcaacagtactactgctgtcctttgcaaaccttgccctagaactgcttttcttctgtttatgctctgtccatgggatgtctggcctacaaggcttgtcttagcaacactaacatgcggatgcagttcagcagcctttgaatgtttttaatctctgcagaaatagggagcctgggaaaggccctggtgggcaagacttgtgtcctagaagatccatccaggtgacttgaagactaaaaatgctacagtttggagtaaagttccatttccctaaagcaacccaagaacctggtggctgcaacttcttgcctggctaacggagagaaagccctaatgatcttaaatagtagtttatccaaaaggcagtatttgccgtgggtgaactttaatggaggagtttcacttctgataagccttctagattactttggctgcccacaggggagggcggtgactacttgttaacacacaagacagttgctctgtctctgtaatgccaggggccagacctagcactggaacactgaaccagacagactcctttattgttctcctggggcacccaggtagggaggttacacaccaaacggctgattcttagtgagatgggattacaaaatgggaaggctgctggatagagctagcctcattgcaaaggcttttgagtatcaccttggtttcacaaagaaacgttatgaaaaacagtgatggagggaaagaggttatctacggatcatccaaaaatggctctccaagaaggcgagagttagttaggtctgagcttgaacaatgagaagaacaaaagttcctttaatctctttgtgtctcagttttcccctttgtaaaatgggagtaggaaaaagagtggtgagcagtgccgtgcctgacacatagttaagtggtatttaatattccctgctgctgctactactgtcagtcattagcattatttttaggctaaataacactgacctaatgacagcgagcactaaaaattccacagaggttgtttctaggagtaaaagtatttttcatctccatggttccccagtgatctgtatcttttggacctaactaactactttgtagaaggattaaaagttatgatcagaattcagatccaaaacaacttattataatgagacactcaaatctggggaggaaatgtacctccttcagctctaaagtgaccctcactaatccctaatcctcagagctgtcctaaggagtgagtaaggtattaatcgaggcttctcatggtaaaagctaaggtcctatggtaaaagaatgtggtggaggtcaaaggtagtcaataccccaggagtatggttgccagatttagcaaacaaaaatacaagacactcagtgacttgttttaggataaggatgtctcatacagtattgagacgacatcctgatatgaaacaatgatttgttgtttacctgaaatacaaagttaactgggattcttgtattttatttgacaactcaacatagcagaccccttaaaaaggtgtcacaggaagaacttggcttgcatttggtaactaggttgttcccaaagttgcctggctgtgaatcctggaaaaaacagaggggatcatgtgcaggaagataaaattcaaggccatcattttgtgcactccagggcttattattattgcatggtcttattgcacggaatgcagtgtaaatcaacctgcactattttaattccttagttcaccagttctaaggtgcacattttttcatattttaacatctttgaaatcaaaacatgtcctataaccaaaagtgtgtcatagtttaattggcagtgtttttctttcttagtagtacataaaataacagcacttccaactgactgtgtctgggattcagtgcactatatttctccatctctcctttctgcaggtaagtcacgtaagttaaatgtgactctgcttgctctgaaaatgctcaacaccaacgctgatgtattacatactggtttccttctgatgcaacaacaatagtcaaaacggttttcacagaagctttgttctttagaggaaagtgcacgccaaagtgacaacgtttgcaaaaacttgaaccaaagtctttattcacattcaacagactgaagtctgtgatggcctctccaagcaaattctatttctgcacagctttgaaaagagatttaaaacaaaaaatctatcttcagtcatcccactttatctgctagaaatggtttttggggaaggtagtgttaacaggatttctgactgaagaactgatacgtgtcgattttgacactgtgctccctcctgtgcactgagtgtgttatcacaaggtatatggggtaatgatgaattccctgctgtattgctcaaaccgcctttgctattgacatctttagagttctgtaatggaatgcagtaggaggaatggttcacaataatttaaatgtttttcagaatttggaacgaacctggagtaaaatgccaaattgtcttcaaacgggggaaaactactttaatgctcttcttacagaagcaaacggctgaatataaacttggatgtttttataaaaacatatttcattattatcacttttataaaacaacatacagaagcagagagcttaaataaaccatttcttatgggttgacggttctgtttacacaggggtttatataaagtctcaaaaggaaaataactgtattgtttttttagatctgatcctctcttattactttctattcaaccaagttttgatgaacacatgatatattccaggctctgttctaggtcttatgaaagatgatacaaagataaataagcccaagatctttgcctcctcaggttcaccatgcaataaggcagacagattcatgcatagataatttaatactggcctaactaccgaactagaagttccatcaaagtgttcttggagtatctggggcagggggagacaaaataattcttgctggaattcaggtctgagattgacttttaaaaatcaaggacttggactgggcttaaaagatggtaatgagattttgaagaaagggtaattctgggcaatgggaacagcttcgttaaacacatgatgcgagtaccagttccccagcaaggcaacttgtacccatggtcagcttcaccaactaattacagcactgttccctgatgaatcctgacctggcttctaggcagctactaacaaacatgtatcagagttagcaagagagctgaaatttgccactttgagaagccttaacattccattgtttaaagatggaataggcacgcacaacaggggtctaaaagatggtctccggccctacaaatgcaaagctgcaaacagctttgaatcttactgagagaaacttattcccttttcagtgatctttcagtccctctgactgttcaagaataaagtctcagcggactagtacgtccttgataaggcatcaacaacacctctaagagaaagagaagagccatccagactggctagaatataataagattgttttgtttagatcatatttatttttagggacatctctcatttatgacaaatcatgtcaagtctccttttaaagtaaatttaagttaaacataaaagaatcaattttaaaaatatatgaaatgaaatggtgtgaaaatatggcattaacagcttgagaaatggcccctggggaaggaagtacaactgaggtgggaaagggtgactcaagatgtgagggtgatgcattggcctttaatgcttgtgggtggcagtttctactgggctgagttctagaaagctacatttttcatggatgcatgggagtcaaaataatttcatgttataagaactccgtcaaaaaatggtatgggggatggtagaactttgggtagggcaggcttttaaaggaaggcttcactgaagatgtagcatataagttgaggtgtgaataatgagtatttaagtaaaggggcaggaaggaatatttcaagcagaaagaacagcaagtgcagaccttcaaggaagtgtggtggttgggtaacaggctggaagagtgagagagaggacttggggggatggcagatcatttgcaccctgtgggcagggctgagaagtttggattttatttttggtgtgatgagaagataggcaaggaagtaaaaggactagaataattgctcataaagaatgtcctggaaggataatgaattaaagggagaaagtgatggcaacaatcagaagagaaagtttgggagagggggctcatttgccccataggctagttagcgtcatggccactaagtgagaggacttggcccctcactatagatggaccttgtcatctggcagctttctccctggtgcttgtctgtaaagcacacagagatcctggcttccctgccaagattgctctgaactagtgtgaaaatcactcagtttttgcccaatatccattctgcctctcttctatcattcacttctcaaagttcccgagaagccttcctggaccattctgattgagtcatatttcacgattctggatgctttcatgcttctggcacctccctggcactgtcctttcagtacatgtttcctgccagacatggagcttcctttgtctatgtgctggttactgagcagactggcgcccacgctggactttcttggtggcccaatgaatcaccaggtgctttcacttgaggcagaaaatggtcttggaccacaaacctctgcctgccacttgtgataccttagaacgctgaagttctttgaatattacttagtagaaaaatatgttcattgcttcccttctctatcctgtgaactggaccttggactaagcactagactgtgagatatctatgtgcaaacaaattaccttcaggtccttctacttactgtgaaagttcaaaagcccagttcctcctccttttctgaacagaaattcaagtaatcaatggagcattaatcatttgattagttgccaaagctttgacttaagcataacttacttgagtaaaagcaagtatttttagtgctgcctgtggggccaaaatgctgaaataagctcttatattaattagtggcatcccattttcaaggggtatagagtgttggatgtttaagaatttgtaacccccaaaagtaagtattaactagaaaatcacagtgctggaaaataattatgccaaaccactgtactataacagaccccaattgcttatccaattatacattgaagtatcacattgtcaagccgattgccaaagcggcaaatgagactttgctagcatcataatttggaccagatattactccactaactacactatgaatagtctttggaacatgctatgtaccctatataaacctccacgaaccaaggtgggcatttcaggtttgttggagtacgcccatgccatcaaaaaaaaaaaaaaaatcactggaattgattagacatgaaagttcacagttttccattgaaagcctgttaggagcatctcagcaaagagcaactgcagctccaggttctgagcagagttgatttcaattaaaatatcaaaggtagtcacttcctgtcagggagaccatcagtaattctatcctcaaatgtgtatctgagaaaaacaaccccagacactgcctcctggatctgcaacactgctccctgattgattggccaccatttagaggtaatttttttttttttcgagacaaggtctcactctgtctggagtgtagtggccagctcactgcagcctcaacctcccaggcttaagtgatccagccacttccgcctcctaaagtgccggggttataggcatgcaccactgtgctcggcctagaactttcttacaacacaacatcaggacagctgaagaacaggagcctggaactgggctgtgaggagctactaaggggttgatattcttaggacaccccattgctatgattttcttctcaaccttgtaagggattggaacgatcttgcccaacagttgggtctgatatgtcagacgaaaatcccactgtggcaagagcctgactcccagggttcagtagagaaataatttgcactcgcccagtagttctttgcttttcaagtaatagtaagccctaaacaatatcaaacttggtaaaaacaaaatcttcctgtctagtccccacattgcccagtcagagtaacatccatcttcgtatcctctcggctagctgtatctgataccagtataggaatcccccttcttcacccagtggatgcctgaaaccagggatagtactgaaccctatgtatgctctctgttttcttctacacatacacaaacctatgataaagttgaatgtataaatcaggtacaggtacaggttaagagattaacaaccaagaataaaatagaacaattgtaacaatgcactgttcacaattgcacaaacagaagatccctgcttgcagaggatcttagcaatttattttattttttttttttcgagatggagtcttgctctgttgcccaggctggagtgcagtggcatgatctcggctcactgcaacctctgtctcctgggtacaagtgattctcctgcctcacccttctcagtagctgggactacgggagtgcaccaccacacctggctagtttttgtagagatggggtttcaccatgttggccaggctggtctcgaactcctgacctcatgacctgcccgcctcggcctcccaaagttctgggattgtaggtgtgagccaccgcgccctaccagcaatttcatcatataatttgttttatttccttattaagtcaggaactttcaccttttctcttaaataccttatgtcctctttttggcatatctgaattgccagcatcactactcttatgctttggggctgttattaaggaaaatgaagggttacttgggcataagcactgtgatttcatgacagtcaacctggtaacagagatggctactcagtgactaacaggcgggtagtgtagacaacatggctacactggacaaagggaggatccgcatcctggccaggacagagtgggacggcgtgcaattttgtcacactgctcagaacgttgtacaatgaaaacttatgaattgtttatttctagaatttttcatttagtagtttcagactatggtaaactgtgaaaagtgaaactggagataagaggggactactgtagtaggttttcaataagcattggtcaaatacgtcactaaattacacttttcctcccaatatactggctatgctagctcatcatccccattttccacataaaacaaggaacttaaatcactcaaccaatgtaacatggataactcagagtggtatttgtttggatgagacacacaaacactggatccactagtggatccagacatgcagcaaactgtatgtctcatccaaacaaatttgctgtatgtctagtgctcttctgatccactctataaattcctgggaacgttctttcagttaacatagttgaaaacatgggtggtaaaacagcatagaaagcaaaactaacactgcaaatagggatcaacctctaagcccggagggccctgctggaaaacctcttctgaggggaaaattgcatctcagggcagttttcaggaattaatcgctgatcaccaacacctcaccccaggcgccatcatatctgaacccttctggtttttcagtgggtagaaaactggtgaggcaaaagggactagagatctctgccagtttgatttcctcaggcctctgtttctaaaaacatgctcactgagaaatgaaatgaaactccttctgaaaaggaggtttgtgatgaagcagacttcggagaaggaagcatttattcaaaaagcaatttccttggccagtcatgttctgtaagcctttttcccccccgccggtgtttcagatattggtgtttaagcaagactgttctcctttaatcctagagtgatgtcaacccacagtactcagaacaaggaatgggaagaggcatagggccaatttctgcctttgttggaatctcctgaacatttcatttcctatttgcttctgctacatatggcttcttttttcaaaggtaccttgcagagtcttcggaagcacagtgtaggcaaggaaactctccaaggagaaagaaaaatctgcactacaagatgctacgcaaacacacaactaagagagggaggcaagcacacagcacgcaaccaataatgcacagccacagaatccttctcaacacaacattgcaggcagcagcaactgggttgtcaagataaaacctatttgaagaagctgatctagctgggacctttgaacaatccagatccccaagcatttaaagcttgtttctctgcagaattcattcaattattcaacaaatatgaacatgtattcagtgtattttatagtgtaatagtaatcaagctggacaaggtagtgcctttgggaggcttacattctaggagagaaggcaggcagttagcaagtaatcatctatcactgccttgggagggaataaaagagggagctacctgagacaatatggtcagaaaagactgctctgaggaaaggacagtcagctgaggagtggcaagtgcaaacaccccaagggaagaaggaggcatctgtatggtctgtgcactggctgaaggcaagtgtctgaaggcgagtgaggaagttctcagatagaaggtagaagatgaggtggagaagtgggaaaatctcccttccctttagcactggaggcgaaagggctagaagacgagagactgaatgattctttcagtcacatcactcttttcaagcacctactttgtgctaggcgcagaagactattaaacaggcaaagctgtaataaatccaaactcagtgagctgaaggtagaaaggccgtcccagaacagctggacccagcactgcctctgaacatgggcaatgacactttggggctcaatgtttgcttactgggtctctcacacaccctaacatcagccctgcctataatgaactttccccagaaaagcaggtgagcagcaagctatttgcacatgtggtgactaccatggagcagcaaggatgcaggctgacctcacagacttctttctgaatgcataccatatgtttggcagagctaaaagagctatcccagcaccatctagccaggtgcttggcactggatctcatatgctggcagatgaaaaatgactaatatgaaaatctatattccaacggtactcaccagtccactggattggtcacgattccttctttctacaataggatcattctgcttctgattacaaaactgcaccctctgaagctgctactcacccgttggaagttacatgccctgtgcagcctacaaatccattaagttctgatggagctattccaacgcccttcaaagaacctggcccatgtgagttgcacaaacaaattggagccaacctttcccaaatgcctctctctatttcatttaaaaaccctctttaatgaagacataaagccttgaatgcatctgaaacgctatgcttaccatgcatgacagcagatcgtcacagaggatttcaaatgcttttttttttctaaccagaatacttgaaagaaactgagatttccttgttatgagttcaactgttcattttatatgccctataattgaccattctccagaagtcagcataggcaacagagatgtaaggcaactgcaaacacacacacacacacacacacacacacacacacacacacacacacacacacacacagctttggcacagtgaaaaattaaaatgcaatgccaggcttgggactattttgaagcctcaggctaggaaagcaataccctcacctttctcagctgcctactatgtacctaaccttccaattatttatggctgagatgcttaagatgtactggagaaacagccatggctgagagatacacaaagctgaaatattatagagagttataacttcatgaatgaaaaacctataaaaatcacttaagggtcctaatctttcagttaatctcacctcagtgccactcaagggtttaaaggagtttcactgattggtttttaaaggacaacgataaaaatgctttgaaataactaattataatttcaggtatctatgtaaaggtccagacacaaatatttgaaaatggactgttcctagaatcagggattgacacagatctttaaaactttctagcccaaacatccatgtgacatttgtatccctttggccatattgctttcaaggcttcaatgctctaggaaagaggatcttactgcagtactgctagatttaggtggagatcaaaattaccaatgtttgaaagtgatatttttacattaacttgatcaagagttagaacttggacttattactcagacagtctgatccttcattgacaagctgtgctgagaaaccattctgtgggctaaagaggatatggactcccaggattgctctggcattgcggttgagaagatatactggaataacctcttttgaaaacagtttagcattacctcctaaagttgacatctacaacaatatgactgccaggtatattaccaagagaaattctcatatgtgtacaagaagacatgcatgagaatgttcaaagaaactctgattaaaatagatagaatctagtaatgaccaacatcccaccagggagtagatgaataaaccctgatatgttcacataattaaataccatggctcaagcaaaacaaatgtttgatagtgacacacagctcatagggagaaatcttaacaatatattagtttaaaaaaattccctaaagacaataaaaatatacacactttaggaatccatagagatgcctaaaactatatgaaaagtcacaaagcaatggtgagcatagattgaggatgctggactgactccatgtgaggagacaaggggatggttttttgtgtgggactatcatactgttagatgtgggatagtagcaaaatcataggttttgttctgggcaatgggtttgcagatactcattaacatcattaaacataactacttacacaactaaagaaaaggaggctatgatggaaaacaaagagaaatgatcatccttgagaggcatgtaagattacaacatcggatgaccgcagttttcctcaagataggaatccagctcccattccaaaatgtccaccaaagttgcaacatagtagcatttgccatataaaagtactggagttattaactggattccagatgtctgaaactgatgtatcccttcactgaatcccgactaggatctattttgggtatagcacttcacacaggttgctgttcttaattaaaacttctctgccttaagagctttatgtctgtgagatagtcatccaaatgttctcctctccataaatgtgctcttatgttttattttcacagcaaaatgcttgcccagattttaataaacatgtccgcagtagtaatatacatttcgcatgctttccacatttcataatctctttagtccttttgtttatgttgattcccacaccaagaaggctgtttggaaggctttgcagctctgtctccatttcttctgcctatcattggggaatgaaacagcacactgattgctatttgggtaggaaacacagacaagacgttgaaagaagtaaactaatttccaagcaattttgctcctttctctctttttgattgattttggcaataactcaccccagttcattgacattagagtaaagcctagtagccaatttattgcttcaaaatctgtgagagttcctaattggttatcagactgtgtctaccagatgccaaaattaaatttcttttaaatcaagaaaaaagtgattttctggcatcccagatgcaaaacaaccccgattaactgttctttcacattgcaaatggctatttgggccttgggtggagagaaaactcatctacttacaacaggagggggtcagattctggactcgatccttcagccaaaatgcagataaaccacaaggaacaaatactactctatgaaaaatggagagctgggccgggcgcggtggctcacgcctgtaatcccagcactttcggaggctgaggcaggtggatcacctgaggtcaggagttcgagaccagcctggccaacatggtgacaccctatctctactaaaaatgcaaaaattagccaggtggggtggtggacacctgtaatcccagttattcgggaggctgaggcaggagaattgcttgaacccgggaggtgaatgttgcagtgagccgagattgtatcattgcactctagcctgggcaacagagtgagacttggtctcaaaaagaaaaatggagtggtgttcctggctgaaggagagatgccctcggtccaatgttggggaaatttttgctcccggaaagtggaaacatcaaaggactggagcccaacattaaggatggaataattatgttgttgttattgttatttttaatggagctctattgagtgcttgctgtctgcctggcaatgtgctcagtgccaagtacaaacatgatctcatttactcttcataagagtacctaccccatccatggtgctgtcatttccatttttagatgaagaagttaaggcttagagatgtgatctcatagctagtaggcagttgggactccagggtcccactccctttctgtctattccccctcctcatataacaatacatagcatttgctaagcaatacagactaaattgaggctctaacttaacttaaagctcttttgcatacagaatgttatttgatgaactctagggtaggtagaggcacaatattattatccccattttatagagaagggaacaaaggcccagggagattcagtgaattgcttgagtcttctgccatgttggactaaaagcctcagtgttgctctactaaaaaggtccctcaactaaatataacaggggtggcctgcatctagtctctgaattggaacatcacaactgacagagcttatatcgtgggttctcttatttaaaaagcagaaattctaggtaatggtccagtgcaatttcgactccatctcctaatcctttgacatcaaatgctctggtcctgacttactggtcctggacatggttttcttggcacagtagcaggcctttaccattttacctgcatctctcaaccctttgtcctgtttccatctcatgtgagtaggagttattctttaaacaactgccttgtatctcactaccagccctttgcacatactgttctccctgcatggatggcatttcttcccctgatccaccagcactggacttaggtggccctccaagatggttccatttcaggacacttattgtacatgccttctaatttatcttccactctataggtttcctgggggcaaaatcatgtcttttcacaatagccaatcttttctttgacttcccagacatcaatgtcatatggttcaatctaataccttaaccatgaccttataaaaccaaagctaggcacataggagaggctcactaaatacttcttgcccagataaacttatcacagtagatattcagaaggatgacatagttgtacccatcctcagtcctcaaataagagtttaattatgttatgtaaaccatatgatatactagtgaggcaggaacagatacacattgtaaaagagatccagaacaaaataagatttctctgtggccttcgccaatcttaaaatgtaactatatttactgaatcaaactcttacagcataataaacttacttacaaagaatcagggtagacagcctaaccttgagtacctcaagtctttgcccctggatcccacataacaatatccttccctcttttaaggaaagctggaaagaaaaccactctgccagcagaagggcaaataaaaggtatgtctgtgcctgcacacagaggttggcatcctaccctgatttgtgacccataattaatgtcaatttcataatttcggaggatagaagatcaacaaggaagctgacctctggctgtctcacagctaatcatcttttgaggcggaaacttgagaggaaacagaaacgacaggctggagcaccaggctgtggctcggagtgtgttttgggtgatctgccaagcagtgagaacccatggtcacgtgccctctctgtgctggccccacagtgacacctgctcaccctccattgggtaaggtgggaacctgcatcccaccctgtagaaggcttggctggacgcctgctagtctctacaaagttccttctcattgtgtgcactcttctacatggcttcttaattatgtatgtgcacaggctgtgtcgaatggagttgcctttgcctctgctcaccacgtattacatttttaatcagtatatataattacttaccgcaagctgccaggccagattttctgagcattagtctaattaacttaaacttgataattatgtttcggataccatagcagtacacacggaacggcagactttgctgccagcttatttgattccaataacgtgttttctcaatactggactagttttgattttttttttttttttgaaaaaaatggccatctgataattactttggtttcaaaatttcccctcagataaacccattctgctatttaggacagcttctcaaatgatttacacggattgaactgttatagtatgtttctgtgtatttttacacacacaaatctgtttttactaatataaattcaaactgaggagaaatgacagtagaaggaattctgatggtcaaatgacagaattgtccatgtttcaactgctctatgcattgccttttccatttcaatttgggttgatgaaaaatgagagacaaggaaaagcaaaacaaaactaaacaaaacacagaaaaatgcccagacttgtaagggagaaaggtcagcttctggttgaacgagggcatgataagttcccacactaataaggctcaattcacctagggcttaccatgtgccaggcactgcaaaaagctcttttttgtggactatctcatcgaatcgtcctaacaaccctatgtggtaattagttattactataggttgaattgcatcctcctgaaatatatgttgaagccctaatccacaatgtctcagaatgtaacttggtttggaaatagggtctttgtagaggtaatcaggttaaaagaagggcattagggtcagccttaatctaatatgactggtgtccttatacaaagggaaaatttggacccagcagctgccatgcacgcaaagagattaagtgaagatgaaggcaaagattggggtgacggatctctaagccatggaatgccaaagatcatcagcaaactcccagcagtgaagtggacacactgaacagattctcccttagagccctcaggaggaacagctctgctgacaccttcacctcgggcttgtagttgccagaactgtaaaacgacaaatttccattgtttaagccacccacccaggttgtggtacttgattacggcagccctagccctctaatacatatactctggttaccactactccccgtttcacagatgccaaggctcagaaaagctatgtgatgtgtccaggtctgcacagctgtcaagtggcagggaaggagtccacaacaggcctttcggactcccatgctcaacccttgacctcacccatgcctgtgccactctgcttctgcccaggaggctgaaagaatcaatacaacaaatcccagaagtggatgaagcactatgaacactgtaatgcttctaaggtaaaagtcaagcttagatggtgcctgttttcacatttgcacatcgcctcttttatttaacacgtaaaatgactgcttgaaatacctgcactctagttttggagggcaacaacatggaatttaaattttcttagggtgagggtagcgggattattttgttctcttctcacataagacaataatggaccaaaaataccacttaccaattacaaaagacaacaaataacagagcacaactcaatgaatcgaattgcagaaggaagaacaggtgggctttcccaagatgtcataatagatggaaggagaacaagagagaatgaacctgctctataaaggccaaagacaggaaatgagaatcattctggggaaaagatacaacctttatccaggaggaaaagcatgggaatatgataataatttttaaaaaagacaattctccaagaatatctcctggaatagatccaacggaaagcttgacaccagataaagaagggaggtcaggttcattgagggcctattacatttggggtatgtttgagggtgaaaccccccatagagtgttgtgaagtagaagctatcgcctcccactttgcagatggggaaataaagttctaagcaattaaataattactaaagggcagctactccttggcccagcaaatcactggaaatgctgacatggaagaacagcaggaagggttgtcctaagaagaattactttccttcttcagactagtagtgtctctatgtctgtggggaacgtgcacaagctcacactcaagacacagacttctcgtcataaaaaaatttcacaaattacctctaagttgctctaaaacgggagtgcttatcatttttaggcatgtcagcactttttagaatctgatcaaagctatgtatgactcctttccctagaaaaatgtgtgcacacacataaatgcatacactttacttgaaatttctagaaggtttgtacaccctcagggatccatgagtcacagctttaaagcccacaaaggatacatctgcctccaaggagcccagcaactttatgacacactaaaacaaacacataacatgcactcgcacaaccttgaccaggacagtccccctccacagtcactggcttgtatctccatgttagcacacccacctccaccactgagggggagctctgctgtgcttcgttgatctgcattcactaatctacattccaggccccacataaagcaagtataaagtgaatgttaagtgaatttgaagttagaagacctggacttgagctctatcactccctctgggtcatgttgtttcatctccttgaatctcacttttatcacccacgctattaggcagaaatcaccccggtttgcctcaccttttctgaaggattgctgggaggaacatatgcagcaatgcaggtggaagccatttagaacagtaacagtgaacactgactgtgtgcaaacactgttttaaacactttacatttattcattaatcttcatgaccatcttatcagggtggcagtgttactatccccatttcagacatgaggaagctgagcacagagaggtcggggaactggcccaggtaggcacagggctgggatgcaaatgcaggcaggctggtgccaaggccagctctcgtaaccactgtgcatagtgcctcttcaggagaggcaatgccacaaaaaatgtctaaaattatcctaacgagaaggcaaaagaaccctgtgagccttctatgaacattagtggagtttggaggtgtggggtttgcagggctttagatttagaccacccagaagagctcgatgttacatataactgcaactagcttgtgcatccacaactccaaattcagccctgtggtggtcagcgaatatcgagggagaaaagcagcagcctcatgtaggaagtgtagggccagggccccctctcaaagctcattcacatgtacttactttgactgccacaacgaacacatttgtaggctttccggcttgtggcttacctgcctgtgaccacaaagctcatatgtaccacaagtcctctttttcctacttcaaacaaacaatgctcatctccctcctctgaatttttttgtttgagagtttccaccttaaggttttcaaggggtccacaattcagttgtatcttgagtggaaatcttattctgtaaggcccctgtcttcattctcacacagtcaaagcacactagctgacaagcaggcttcgagcagagccatgataaagcttcaagccctgcctgcccagagctcacagccccggtgggtgacccggaaaataagcaggcacctgcaaaaggcctgtaaagtgctgtgatgaggaaaatatgggcaactgtgggagtcacagaaagggggtacctaatccagcatggggagagggagacactagagggtccaaaaagctgcgtatcttctctgcctttgtattgtcacaaaaatctaggagtcctcatgagctcaatgttaagtggttgcatgctttgactcacttaatcgaaaatgtttttaaaatcctgcttagacctttttcctcccactgttccctgagttagctccttctcaccctctgggtctcaatttccaatgtaattaattccctcttttcacgaagccttcctggagcaccctacactgcctggcatctcctgtgccatcttcctgcactttcttcctttcttcccagggaggcaggcttcatcttgatgtcccgggtgtggactgcagaccaacatcacctggcggcttgttagaaaagcagaacataaggccccatcccaaatgattcctcaatactttaaagctgcctcgcccaggaccttagccatcagccccatgtgactaccaggcccctgtaaaacggcttgtctgaactgagaggtattgcaggtgtaaagtacataccagatttaggagacactgtgaaaaagactgtaaaatatctcattaataattatttcatgttaattacctactgaaataatatttatgatattttggattaaataaaatattacaattaattttatctgtttttttaatatggctactataaaactgatagtcacatgtgtggttcccattatgtttattttggacagggctgccctacagcgtgagatgcgctggtttggataatgatcaagaacaggcattggcagacgacagccactgggtcaaatctggccaggtgcctgatttggtaaaggggcttttattggaacacagtcacactcactcatttactgtctttggctgcttttgggctacagcagcagagctaaggatttgcgacagaaactgaatagcctgaagagcttaaaatatttaccatctggccctttttagagaaagtatgcagaccccagtcaagaacgttcattccagaactggaccgattgacttaaaatcacgtctctaccactttttggtgtgtgaggttcggcaagttacctcacctgcctgtgcctcagtgtttgtatctgaaaacagaagatgagcatacatacctaacagagttgttatgaagattaaatgagttgatatatgtgaacttccttaaatagtgcctcatccatagtaggttctcaataaatgttagccaccattaatattactgctagcagttatcacaaattgtaatgacacatttttgctttaactttttttcctgtctgtctccccatcaaattaaagacctaggagagtggcatcattttctgtcttgttccagctgtttaagcacagttaaacagcccacacgtgagattcaatacatatttgttgcatgaatcaagtgcagaggagggaagtaattttcctaaggctccacggccagaaagtggccaggacttgaatgtggttctatctgcttgccaaactcaaattcttaacttctcttgatacaccaagtgtagtctatagaccagcgacatcagcatcacttgggagcttgttaaaaatgccggagcttaggcttcatctcagaccgactgaactaaaaactctattttaacaagatcgccaagaaattcataggcacattaaggtttgagaagcactgctctgggctataattcccagtttcgactcatgtgcttatttgttcaacaagcaattaatttagcatcaatcattccacagagccttgtgtttggaccccctaattccagagctgatgatttctattcatcccgatcaggtcctgggggtgtttagggtttgcaatgaacggcaatgtgctgtgtcagaagtgccctttctcctaccaggttcaaaccactgcaatgctggagtgacctctctgcacagaaatctgcttaacattccttacccgcctgtagtgaccaggccacaggctccggcagatgcagaaggtctgaaaatctagttgtaagtaattttcctctaggtgcctacctcagtgaattggttctcctgtgcattttatacatcagtggtcgcaccactcaaacacacaatccattcccgagtttaacagctcaggcaccttcctttttgattttataaatgaatgcaaatcatctcccactcatattataaaccaattaaaattctcctcacacttttaaaaaaacttgttacctggctcaaagatccttagctcttttcttagaaactggcccttatgtggcctgtatgtgaggatgagggtgtttgaaattagcaggaaatcttagaatggtttcccctttgtcacagccagaagtttcagattgtggtcatcagatgaacgctttaaatgagaaaaagactgattagcataattcttaaaggtctgaactctacactcacagatggcctctgagaggatggatggtacagaaaggagattaggataaatctaattagtttgggggtgttctcatttctcaagtggtgagcgatggagaagaagtgatggatggacagatggagataatgaagccccattaaagccttttttgattctcattctccatgatggagcacattatcccattaatgtttctgtgagctaacacagccaaagtttggcgctgtcacctcgaaaatgaattcgaattgcctgcccagctccttacatgtgtccacaggagttaaatgagcctgaaaactgtattcctgctgagaagcccatcctggcagcatgggctggaagccctcccctttgggaatgggccttcctcctggctggtttctaacagcactcaggccagagtcccatagcttttctgctccggggttctacaactagaatttcctctgaaatgggctgtggcttgcacgtatttccagggtactgagacagaccgctgctgttctcttcagtggaggtgacagctacaagtgctcaccatcacactctgattagggacctgagggcagggtccaaaaacaaaaagtggcaagacaggcccatgactcagtcacagagatgtgacataaataataatacaggacattgcacaggctatgtgcaaagtaagggcctgactggctccactagctcagagaacagtgagacagtgatgggccatccaggaaacagcagggaaaggggagagactcctcggggtttgaaaaaagaaccatgtgccccctgatgacagcagcctcctaaatggaccccttgcttctactcttgactccctacagtccagcatcatttaagaacataaaccagatcaaatgattctccccttcaataataatcagagctgacatttattgagcacttacttatgtgtgctcagcgctgatccaagcacattgcatatattatttcatttcacaacagccctttgtggtattaatatcatccttttattacagatgaggaaattaaggcacaaacaggtgacctggcccagtaagtagcagaatttattgacaagctcaggtttcttgacttcagaactccgattcttaacctataactcctgttccatgttcattccatgccctcccaccacacatggaataaaatctaaactcctctctgacctcattttgttccagtgtctcccatgctcactgtgctctcgtcacattcttcaagaactccaagcacggtccatgtctaggccctgtgcacttgtagttgcctttgtctgcttagaaaggatttcccttctcccatatccaccttcgaaatgtcagggtggcccacgcttgattctcagctctcttactttattctactgctcttcccaaccaggtggtctcattcaaggccatggctttaaatactatctcctatgactcccacatttatgtttctagcctggaacgtttaatgagttccaaccatgcgtgtttaatggctcatctaatctttcctctcgcatgtgtagtgggcacctatatttatcacccaaagataaaaaaaaaacccctgacttgtaactctcctaccctacttcagtctgtaaagtaaatagcactatcatccagctggttactcgagccaaaaaccagcaattcttcttagcttctgagcctttgcacccaatccatgaacaaattctacctgcttccaaggcacatcccaaagggcctatttctctccacctccactatatcatctctgatataaaccactgtgataattttgcttgcacttttacctctctttaatccagccagggagtgacccttttaaaagttaaatcagatcatgtcattcccttgcctaataccttctaactctaatgtcatgctaggccctgaagacctctaggccaccgtctgcctctttaaccacaactcctctgcctgctcaccaatgctccgggcacactggcctcccttctgtttcctgaacatgccatgctcatcctggatgtatggcttttgcaatcactattcactctgcttagaaaactctctaccccaggtttccccgggcttacagcttctcatttagttatcagttgaaatgttacctccttggtgaggccttttctaacccctctaaccaaattcatatgcataaatactttctttatcataccaagtttcatttccttctcactctctgagatgtctgtgtgtttaattggttttttctgtctctcctactagagtaatctctttggcggtctgggtctgatctggtttgttcacccctctatcccccagtgcctggaactttatcagggatcaataagtatctactgaatgaagagcaccatttatttagaagctcacaaaatgctaatggaggaggtaagattgaagacagatgataaagctgggacttcaatcctatagtcagtgggaggggaatggataaagagtaaaagtgacgcaaacttgtagggagtgggaggaagtctaaaatcttccatttgttgaatgaccataacccaggaggccctggtaatacacaggtgaacaaaaccaaaatggcccctggcctcatagagcttgtattgtagcatgtagtttaaacttttttccccattttaggatggagcaggggtaagcaaatgttttactgtaaagggccagagagtaactatttctggctcttcaggccatatggtctctgccacaaatactctgccactgtagtgaaaaaggagccacagatcatacacagacttggctgtgttccgataaaactttatttacaaagacaagcagcaggtccaacttggcatgtgggccacaactggacaacccctgggacagagacttctgtcccttctaaagaactggggagtactttaggcttgtcatgtagagaaacaggctttgaatcataagaaccttaagggtcttgtggagaaaaacatagatttattatttaccttaagttttctaaagcgcttagaaaacagtgagtggacctggagctgctgacctggggttcctgctagtcttttgttttactccttcccatgaatcaactagcttttgtaagaaacctcacagttacatggatttgaatatacttaacctgacaaagactaactcaaagtggctaatgcctataccagatggtggacctgcccttattccactgttagaaaggaagagaatgggcactactgattacttgtactgatttaagtttaagctaatagcttggcattaccctgacttcagccagggaagaaaatcacatccaagtttgcagactccatgaaacattggccatatatttgttggctcattagcttggacataaagactttctagaaagagatgccatcattaggtgccactcagactctaggggtgcttttggaaaccactgtgatcagaaacgtatatattgttaagggaagagagagagttgttctggacaggtaccgagaggcaggttccaggaagctgaagccaacagaatcaaaccttaacgtacataagccattcctgggctttgtccatgggttgcctttgtggtggttgtctgcctggtttccagggagccttcaattagaattctgagctgagatgatttatcctgtgtgctacattagctccatttgccattaacataaataaggctttagttacatgaggcaggcataaagggtatgtatgccttccattcatgaaaacatcattttttcaaaacaccagtttcttcttataagctaagttacactacccaaatatgtagtaatcagtaatacagaacaataaaaggccttgatacactgatccgggcatacgaggttatcaggaaatcctcaagtcagtgtctctccccatgggaccaatcctgtacctctttttccttcacctccattttgacttgaaatgcagtagacaacagagccagttcagtgccttgccatgctcccagcacttagcactgttcgataaatacatgagggataaacaaattgtaaggaaactcccatcccatgagaggagaaggattctaaagtgcatgaccacacggacacacaggtaacatccatctctttgggaaaaggagtaaaatggactttcctgaaacaactgctaggcagaaggtgggtgaaagccacaagcatagcctgcctcatagtagttccacgaaagtccattttacccctcttcccatagaaatggacactatctatgggtccctgtgtgtggctgtctcctgccatgtcgctggattttctcaggatccctgacaagtagggatttttggtcaatctttcatagacactcttatctcctcaaatggagacaccatcactggcattgaaatgctaaggtgagaactcaccaagacacactgtaggtaaagttccagctcagcttagggtttgatatgtaacgggcccaataaatgatagtgattggtattaggattgctttgttcttgttacagatgaagaagtagaatgtcagtggattacagtgaacagtccaagctacaaaatgtgttgcaactggaatttgcattccatgtgtctggttccttctctatgtacaggaatgaatcaggagagcacactggctctaccttcttccactctgacttctcagctttaatccctggagttccagggtggtatggactgaatgtgtgtgcccccaccacttccccaaaattcattaacaccacaatccagttaagatatttgttagtagggccttcgcagaggtgattagggttagatgaggtcatgaaggtggagccccaggatggatttgtgcccttataaggacatgaaggaccagagctctttctctccaccatgtgaggatacctcaagaaggtgaaccagaagcagggtcctaaccaacaccccgaccatgttagcgccctgatattggacttccagcctccagagccatgagaaataaatgtttctgtttaacccgtttagtttatattctcttatagcagcttgatctaaaacacagatacctcaagatggctacaaattctcctctaagtgcttcagagaggattagaagataaattatatatctattttgttttctatgctaggcctctatgatataatataaatataatcatttgtattataaactagaatataatacaaataaaattgtattataaactaccttaaagaaagtcctccttacactgaaccaatgctaatgttggttaagccaatttcccttagaaaaaggcatgtaggatcttgaaggcattggtgggctgcattccctgcactgtgagcaaggcctgacctagaatgacctgtaacatcacccctgtcatgggtcccaagcgcacagccaaaggtcttcaaaacatatgggtatccttagcaaataagagcattgctaagtgcatgattaataagccagaaaggctatggcacttgacagacggatgaggcatttcagaaagataagtcaaagtgcactgtgaggtgagtgcctcccttaactttcttagctgtgctactcggttcataaaccagggattaagtccattttcatttcaattttttatttcacctttaagcaactcctaaggcttccaggagaattttgtttgacctttagctaaagttcaacttctaccaagttacgaattttggatggtccctaaatgatcacttaagacagatttcactataattcaaagaaaggataatccctggcccaagagttcacaaaggaaggattcccagtggtcccagagatggcaaaagttatggatttcatcctgctaatgcattttagtgatattttcattgtgcaacattaattaccaatgtcagcctggatgcatttgctgggtattgaaaccacgacatttttttatctctacctggtcccagatgaagattagcttagtgcttccttgtgtcctaggccctagagaaaagatgcagcctacgggatggggtaaccttggcaagttgccatttgcttctaaagttatgatagcagtgttgaagccgtcactgagactctggtgctcaagccaagtaggagccctttgctatcatgacatatgctctagatttgcatttgtctaaaatctagcttttaggagacctctcagagatgtctcagggaggaacactcagaaaatgtgaagaggagcaatggacagagacagagacttccaatttatagtgaagaacagacctttgaagttgacttgttacataacctgacttatctaccagatctgtctgattcctaaagaagtatatgaaaatctctcaatttatatttcaaactcctgaccttcaggtgatccacccgcctcggcctcccaaagtgctaggattacagtcatgagctactgcgcctggccatcaattttgtctaatcagagttttttttcccttgaattttggattttgtagttaactactgggttgttgtgtgcctgtaataaagatagagttatttttgtccacaaaagttgaaaacagagctgccagttgacatgaaagtacaactcatttccatccacagcctctacatccattaaataaagagaaactcagtgctcatctcactcatgaatcagaacaggatatctgcacatgccatttctctaacttcccaaatgcagcaggaacacctcagccccgctctctcagtatctcagtggactggaagcacgttcatttaagaggaagggctcatagctttctgcagacagttcaataccatgatgcatccgattcagtttcgtccattctatttcttattgatcagcatacctcaggctattagttttattaattaaatgataattttggggggtgagtacacaaggagataaatgtctcacaaacagactccaagcttgcaggcaggaggcatgcagtgatttacaaagtatttatctttctggcatttttttttcccccaggaaaaagtaatcatcactaccatcttctaaaaacagagatgcttgttttctgggcaggcttggaaactagccaagacagcaggaagattgctggaatttcaacacacttgctgtggtaccatggtgctagtgacctgcccttgcagatataccttgactccccacagaagtcacctcaaagtctctgctatttagcaaatccctaggtgtctggggagtaggggtccagtctggggctgctgcctcttctgattggctgcctggctctgactctgatcccagaatacccagaggaatttgtttccatcctcctggcccacaactcacacaaacctctaatagtacacaggttattaaaagcaaataatagctgggcacagtggctcatgcctgtaatcccagcactttgggaggccaaggcgggaagatcacgaggtcaagagatcgagaccatcctggccaacatggtgaagccccttctctgctaaaaatacaaaaattagctgggggtggtggcgcatgcctgtagtctcagctactcgggaggctgaggcaggagaatcgcttgaactccggaggtgtaggttgcagtgagaccaaatcatgccactgcactccagcctggtgacagagcgagacttgatctcacaaaaaacaaaacgaaacaaaacaagcaaataatagtgtcccaatagaagcacttgccctaccacagccctctctctctgccatcaccaggcactttctgacatttccatctttctgacagggtttctcaacctcagtctctattgaggttttgggtcagataattcttagttgagagaggtggtcctgtgcattgtagggtgtttggcagcatccttggtctccacccacttgatgtggtgagcacacacctccccatccacaaacatctccacacgttgccaaatatcctctgggggagctgatttgccacaacccccacaccccaccagtgaaaaaccaatgtcttgggacaagtggaaagtgatgggggaaactgaaacctccctgacgctttggttcctgtaaggaaccacaggagactacatcattgtcacctctccctggtttgcagacattatttctgagtcatgtgaatgaactagaaaccttaaataggaagtcagaagggaagctggggaggagagtggggaccgagttgaaagatgatattgactatttgtacttttcaattagcacaggtgcaacgcttcaggattcttggccaaaaaatgatataaaaatgattggaccgacctgctctttctagggtaaaggtctgtgagtcatatcactcagaaaacatttttgagcacctatgatatccctcatccagtcaatcaagagatttaacagattcttcttctctccctccctgcagccattcttctaggtcttgccactattttcttcctcctggattctcccaagagcctattctctaccttctaccagccttgtttctcagtatccattctctcactgaaggtgagtggtctttttgaaatgcaaatcagatggtgctagtcagagggtgctagtcagccatctgctagcttccctggctttccattcttttcggataaaatcccaactccttaacaaggcctagaaagccatacattgcctttgttatttcattacttacaactgtgtggtccaactccactggaccagtcttgcctggttcctcccagagtgtgggacactaaccaccactgtgtaggtaggcacagaaggtggctttacgtagaacgcagtcacgaccttaaaaaatgttgaatcacatagtgattctttaggttcaacatcctttttcttccttgtgctctctcctagagaaagtcagttcggtgctcctttgtccttcctgcaccaaggcttattgatcaaccttcttgtgttagaaaagaacaagcctcaggctccaacatagaatctagttggcatttaataatactattttatttttgattgtacttacttttacagttaccttttgtattagtctgttctggcactactataaagaaatacctgagacagggtagtttataaagaaaagaggtttagttggcccatagttctgcaggctgtacaggaagcatgatgctggcatcatggggaggcctcaggaagcttccaatcatggtggaaggcaaagtggaagcagacaggtcacatggcccgagcaacaagagagagagaggggagttgccgcacacttttaaacaaccagatctcatgagaactcactatcacgaggatggcatcaaggggattcatgagaaatctgcccccatgacccaatcacctcccaccaggccctacccttcaacactaggtattacaattcgacatgagatttggtggggacacatatccgaaccatatcacctatttatggcatattataaatgtttccagtataacattccagaagtgattagtgatgcaatcttgcctttttttttttttttgagatagtatctcactctgtctcccaggctggagtgcagtggcacgatcttggctcactgcaacctctgcctccagggtttaagcaattctcctgcctcaacctcccgagtagctgggtttacaggcgtgcatcatcatacccagctaatttttgtattttttggtagacgtggggttttaccatgtcggccaagctggtaattccaagctgaactcctgacctcaagtgatccgcccaccttggcctcccaaagtgctgggattacaggcgtgagccactacacctggcagcatctttcctttttcagtgcatgtattcaggtagaaaaagaaagtttacttgaagaaacataaatagtagtagcagtagtttctagacatggcaaataccaggattaatgcttggtatttgggaaacaaggagttacttaaatttgcagcatgctctcatatgccagacgtccttcagccaggctaagaaggtggagtgggcaggagtaggagacattggattgttccttgtaatctctcatgcaatctttggagtttgatgcagatgtcaccccgccaaaatttgagtcagtgccccacctatgcgctccgctaataccttcaacaccccgcttagaggatctgtcatggcgcctgtgagctctgagatcatgtctgttgtgttcactgttgtttctgcagtgtctgacatgcagcatggcagaataaacaagacaccaggtaaatatatcttggcttgatgggtgaaatgggggtaaggagggaaacttatcatccttttcagccaggtctgggccacaccaaaagtgaaaggcagaatgagatgcctagataatccgtgccaataaagatgctgacccacctcctcctggacaacagagacaaaagagttaataatgtgaattacttggggtgcagcttccatctccctcaccacttaaagtgtcagaatttgacccccactggctaatgcaaaaaacacacagaagctggcaagacatgggcttgcttgtccctcctctttctttctacctggagctttacctttacaaatttgtagcacttgaaggtatgtttccctagccatttctggatcataacaattcctttttcctactgacaaaatctgaaacttagccggaagcactctcttgccagggaaagaactgtgtcagacgtgcgatgcgtgataaaatactacggtaatgtggaataatgctttcaactgttgccagggtgagcatgcatgcagaatgatggaaattgcctgcaaatacaaatggttgctctgtggctcatctgtaacctcaatgtaggaaagcggagatattcttttccctcctttgcaatttgcacagcctcttgttggaaactatggagattatgccattgaaagtaactgccatgtttactcaacacacaatttttactaatacagtctccccatgtagtcatctgtcttgtgaggttccctcaatactccagctgttcctgtggctgctgctgcgaacacctcattgaagaaatcaaggtgccaaacccaaatgctttatgtgagggtgtggaggtcatttttgcattgctgaaaatgacatccactttctaccttagaaacaaaggctgcataactgaatgggattcagtgcacccctacccccttctcagtggtgaattcaatgggaattatcagagggctggtctgtataactagaaaagccaaaattgttgggtgtttactatgtgttaggtattttgccttcttttaggtgaacctcataacatgctatatcataaatattatcctcctcattttggtgttgaaaaactgagagtcagaaaggttaactaacatgctcaatatctcccagataataagtgaccaagccaggatttagtcccaggtctgtatgactctaaatcttgaattatttccatgacaaataatgttaaactaaagccagcatttttctctttgagttgtggttaaactttcattatctgtggcctttaagcattatttgttggttttcacgtacccataactatcaggatacatgaaccaatgggaagtcacgtcctcatgaagagccagtagcctaaatgtgaaatttctcatgcataccagaagcacaaggggcaaaacacacacacacacacacacacacacacacacacacacacacacacacgtcaaaggcttctccctctttatgaaaagtaaaatgccattttctttttctacaaagggaacaagataattcattcacggatctcttgattagctcaattgttctgagatgataatagttaccatggattaggtacttactacatgccaggaatcaagggaagcactttgcaagaaggataacataatatttataacccaatgatgtaggcactactattagtcccattggacaaatgtgaaaactgaggtttagagattatgtatcctgccaaggtcactcggttcagttgggattcaaacctaggcctctctggctctgcctccatgttcttacctgctatgttatcttgttttctacaaacccttcctagctaccatctatgtgctggataaataagggaatctttttaccgtagagtgaaaatgagaagttctgaggaagtgacatagtgttctaggaagtgccctcctttaagaacaaagtaggctggtttctcactgccaatcaaagtgtgacattggcccttctggggctcacctttctagtctgcaaattgatggtagcaaaggacacaatgtgtaaggacccttcctgccctaacgttctgtcattctattaaccacattttcccctctcccatcatttctcctgggctttgattttcactttttcatggccagtagaagtcacacatacccaaggcgaggctgccctcctctagtgaactgcaatcatttgaacatcctgcctcaattgaatcatcctgacagctatccctatggctggccagtcaactcccaagcacttcctggaaatgcagatgctgtatccagggcagaaagtacttcccctgtcatctcactccctctctgggctccagccccaaggccttttaggtcttcagactggctccgtgccacccttgcaccagtgcacatgctgttcctctgcctggaacacattttcttccctgcctcctgtggttaggggccaggcaggtttccctaaacagggctaaaggcaggctacgatcctcattctagattggccctctcctatacagtacttctctgaattggtccctatttattcagttggatcagtgtcttagtcttccactatactcacccttgtgtccctgcacccagcccagggcctggctcacaggaacctctcaaaacctgttggtagaagaatttgcacattaacctgccacccacatctgtgttctcttattgatgaggtacaagaaaggaagatggtaggccaatttacagtggggttatgaggctaggtctcctctcagcccactaatgtctcagaaccacgttctttgctgagttcatatgttttttttttttaccccatctccaaacagcaagtaatcttgcagatcaatgcctgagaccaaagagacttatgaatgttaagaagattatgcacataaatgtaccactatgacagccccgctaagaagaatagtgatatcgcactgcgtgctagtttatcaacctttgctacttaaaaaattcacagccaatttaattaaaaatataacagctctgaaagctgctaaaatgactatgacaacaatctatcattttgtaatagtgctgaagatccattagggactttgcactggatgccaactttttaaagcccagatagtaggggcatttcattctgcacaattaatgtcactgcatttaaaatattgactatctatgaagaagaaaataccaaacatctttataacccacattttttatggtcaaaacttgcttagaaaggtgctttgaatttatttgttataagctgcacatttcacgttcagaaaattaaaatggtttctactgactaactcatttaatcatttagttgatttaatgaaaaacactatgcatttttctcttctccgttgctaagattaatactttctgttcattagcaatcaaatattgcaggaaggtttacatcttattctcacttaactcattgccttttatttttaaaaaattctaatagaattgaaatggtatcttttaaatcaggaattttcctcttggtaactcgttttgtcttgtggaaaacacatggctagcctgtgacattgaggcatttatgtctgaattgtttttctagtctttttaggggatgcattatagggaggaaagggagtggacactttagaaaaattatgaatctagttttcagggcccctaactcattaatacatcagtgacattctagcatcctttgaaattctgttaagaagggccctttgatttattagtgggattttatgagctacctgggaaagtgaacccattaaaaatgttaactgtaagcatctggcttccattgaataaagaatcgaagccaccacataaaagtgactctgcacaaacatggcactcctctcccatcactcccaaagcttcccattgtaaatgccacttcatcacagcagtgccatttgcagttgtagtctcatctctgttatccactgctattttcaggagtgtataaatgagcagcgaaattcctctcccctggaaatgcctgtaagagcagattctaaaatgggaactttttgtgacaagattgggtacaaaatagtataattactgtaaattgttcaataatagggccagtagtttaaaagcagcatttccagatttcctttgcttccataccaaaaagcattttcttgaaccccaattgcttcataggaggaaataataaaaggcaggtgatagcattttgtacttagcatagatacaatggtttaaggacacggtgcactgagtcaagaccactaagaggtagagggcaaattaaccatttggacagtaggaaaaggaggcattttaaggtggcatgcaatgagccagccagctaattatagtaagagcagcttccctaacttttactttctatttcaaggtgttcattgcttctctctctctctctttctctctctctctctctctctctgtgtgtgtgtgtgtataaatcatctgtcttcatcattgcattattgatattgattgattgtaggaggagaaaacaagaatttttccattttatagttaggaaaactgaaacacaggcatcagtgtgctgtaaccctactataatgctcttctctttttacgcacttaggaaaaggataatttttttttaacatttgtgcaattatttaatatgtgtctccccaacactgtaatatctatgagagccaaatcactacctgtcttgttcatcatcacagtcccagcactaacatagtccctgctatatggttggtaggtgctaagtaaacttttttttaatgaatgaatgaatattattttctgaggtcattcctattggagcattagtaaagcaggacaaaactccaggtcacattcctgtactattgttgaacttctattcacccttcaggactctggtgaaatgtcagcatctttgggaagcctttctgagttctccctgactttgcctgggctccattaatgcttcgtacttaggcctgttgtgtgttgtttcttttgcttccttctcttcacggaactactctttcatgtgggtaattatcctgttcctcaggctttggatggggttgactccatttctaactggccttgggatgggttcataatccagatctggcctctcagggaaccctatccttctggccatggttattggctcagcaatgatcctgtagcttaacttgggccagcatggtctgtgcaaagtttttataggcattactgaagcagcgggggtggggtgggggaaacccacaatctttctaccataagctagtaggatgtgagcctccggctgctggtgttcgcattaccttccctgaggagaggttgcctgagagaagcagagagacacaaagcccctaatgacattgcttgtgcccctggatccagccgcgcctgaatcaacaatactattagacttttcagttacatgagctaataaactcgttctcattctcttaaggctcttaaggcaggttgagttgggtttctataacttgcaaagggtctctaatttctctatgttgcagtctattgagcatgtactccatgaaatgtgggtgattcatttctgtattcccaatgctgagtataggccttgtccttagtaaaggcttgttgaattaaaaaaacggtgcaattctagggcaaggacatttccacaaggccaggtattttggggatgaccctgtcaataagggctatgtatcttttggatcaaactctcatagaagaaggaagacctcataaagacacccagaaagtaggggcgccaaggtcaaccagaagagagaaaatggccttcagccagtcaaggagtagcttacggcagctaagaataagacagtgggagctgtgcagccccagaatggatttcccatgcctggttttaatcatggctatggtagtctatgtcttggttttaatcatggctatggtagtctatgtcttggttttaatcatggctatggtagtctatgtcttggttttaatcatggctatggtattctgtgtcaaatggaatgactaatcctaggtgctttggaaatgttaaattgttcataagtcccttagagctttgtttctcctttgaaccccatggagggttttgggcctcagaacaggtatattaaaccgtctccatttcaactggtaattgagggcctctcaaagtctacctagaagagaatgtcttctactatagaaagaaacagatgatgcaaaattttgattttttaacctaaagtttggtcctgtctggcaaaacaattgaagaaacatgactttccaatctatttggaaggtgagggttccaagtacaccctcactgtgatctgaaaattgtgaaaatctgtactaatgagaagcttaggaatcacctagacctgggtttaaatcctagatttgccacatttctggggtggtggggtggactgacaggccctgaacagacaacgtctatgagccctagtgttttcatgtgtaaaacaggactatactgcctcacaaagatttgatgacaattaaaggaaattacagatgttaaatgcttaacaagaatctagtacatagtaagagctcaatgtatattaactgtcattgtggtgacaacaatcatgataatttcaagcttttatatccaattttgtgttggatgcttcattaggtaggaatgaacatctcaaacatatttgtccatctatcattatttctatatatgttgttcacccaaccatcatatcaaattcctgttcctttagtttggaggtccttattttttgggggggggggtcatgaacctccttgaaaatctgatgaagtatgggtgatgtgctcctctctgaagctccaatagcacctcacaggttccaccttaccccactgtacctccatccgcctgcactgtgactgcttgtttattcctttttccaggctctgggaggtcagggagtgtatctgcccagatcatcattttctttaccttgcttagctctgtgcctggcagagaataggtgtttgatattcactgaatgcataaatgaaaattgcaaagccttccccctgaccccttaaaaattcacctacactcaagtttttgcatctaatttcagaccctgtctgaggactccaggtaagaagctactattaatgactacctattgtaggtcattaaaaatgcagtagggaaattttcaggccaaataatgaagcagcctgtttttcaggccaactaatgaaacagccttaccacaggccagaaagaaagtgtagatcgtcttctcaagagaggaaggacaaagtcagaattgacactgtgttcgtgatgaaggcaacctttgtccaggtcccttgttttaccaaagacgacaagaggagccagccttgcccaaggtcacatggccactggtaaagagacttgagcctcctggcttccagaccagtgctcatcaaactcaaaccttccccctcttcccctctcgcactgcctccccagaagctcagtccttgcgagaattcaatgaaaatttccttccaagcatggtccgaagacaatgtaaggaaatgcaggatttacatgactttggtcaagtgaggggacaggactttaaaccaaagagttgatttaaatcttttaaaacctacagagtgaagggcttgcctcattgcctcatttgaaagatgaaatcattctgtctttatttttcattgatgggagtttggctttggagggaaaaagatctggcacttgagagctggcccagtgaggataggggttgtcattttctcctcactgaggcttagcaatgcctttagctaaggcccggcccatgtatccccaaaagtgacaaaggtacagtatttcacacaggaacacttggggagcatttttccatgggacacggcgtgagaatccattaatctcactgccacatactcaggctatttctcacaagcttagccagacatttgggtttttttaaaccatgaaaaaaagagccttatcctcctcatcataccagattgctccagcggataaacatcagacatggtttttagagaaatatcacacgatctgagaacatctgcaattctctagaacgtaccgttgtcagaacttgacttaaacgaaacaacagacatcagactttctttcagacgttttgcactgaagctttccattatagcacgaatgcctccttctgaaatggcaccaattgaaaacgcaccaggacacgaacattaccacaactcaaattcagatactcgcatgttattaacaatggtgctaattcctgtttcagagatgaaacttacagaggagataccagtgggttttcctccattgctacttttcatttgctatggaggccacaaattcaagagatcactcattcttaaattaacaaaagtagccaccacctggcaaaacatcaggccctgtgcaggcgctttatatgcacctttatatgtatcgcctcttttaagcccctcagtggtcctcggagacagctgctgttatcttccatgtcatacatcagggcactgaggcccagagcccaagtgatattgtaacagcacttcctgtgtgctaagcactctccatgcattttatttatagtatctcattaaatctcaccaaatcctttgaggtcagagccatcataagctccaatctacagctgaagaaactgagacagctctcaaagctaggcctagtttcctccaaagttcagtcacatttgttccatttgacagtatgagggaaggcctttttttggttaagcgtatagactctgcagttaaacctcctggaccctacccttgttagcagtatgatcttagataagcacgagttaactttaccatggctcagtttcctcacctgtaaagtggcataataatggaacttacttacttacctcaaaggatgaagagaatgcaatgcaaagcatgtagcatggggtctagcatacagtaagttctcaggcagtcattagcagtattaaaaataatactggccagtggctcatgcctgtaatcccagcaccgtgggaggctgaggcatgcggattacttgaggtcaggagttcgagaccagcctggccaacatggtgaaaccccgtctctattaaaaatataaaaattagctggccattggtgggtgcctgtagtcccagctactagggaggctgaggcaggagaactgcttgaaccctggaggcagaggctgcagtgagccgagattgtgccattgcactccagcctgggtgacagagcaagaccctgtctcgaaaaaaaaaaaataccataacattttttcttcttatttttatataaaataaggctgtattcataaaggatacagggattaaagcaaaccaaaagagaagagtgagggtaagtttaattgtgtgataaggatttaggtaagacagcctaggcaacatggcaaaacctcatctctaccaaaaaatacaaaaatgagctgggcacggtggtgggtgcctatagtcccagctactcaggagactgaggtgagaggatcatcacttgagcccaggagtttgaggctgcggtgagctatgattgcaccactgtactccagcctgggcaacagagcaaaacccggtctcaaaaaacaaaaaatacaattaataaataaaaagtaaaaaattcaggattaaggtaagaggtgccccgctgtgcagcacagagctccatcggattggaaaaagtggctgccaggggatgcctccccttattagttcagacaggcttatgtaccggtctccttgcgggaagtcctgtgctgctcagcgttgatggaacacacaatgaacttttccttgcttttgtctctaccagaactcgactgagtgcgccctgctgtgtggttttatccctggtcttgggataggtttccatggctataggaaagaggtggagacagggaatgccaccttctgagttcatcagaatagaagtgtgcacctgcagcaagacatgattctccctaatttgctttcaagacaaaactgtgtctactgattgggtagatattgttgaggcaagatgcggtatgtctagcctgtgtccaacacatatggcgttaggtcattcctttcatctcctctaatggtgcccagtacaatgagaatgaaatgcaaatcccttaccctggctctgggccacccagacccatttgcgggtctctagcaacacccccagaccctctatctctcccttggtcacaagggcttcctttcctctttaaggtccttacaccagctcctcctttgcctgtgacactctgtttccaggtttttcatgtacgttcttcttctgttgggtctctcctcgaatgtcagtcttcaaagaggccttccttgtgactccataaaccactgcagctctctgattcacttccttactctgtcttgtttttctgtctgctaaaatagaactgataatcctcgtcctccttctctcacagcatttctttgatgagcaaatgagattcatgtgtatgtgtctatgaagatgcttttataactgtgagtaatcaccagggatgcaaaggagggttcaatttctatgtcagttcacactgggtgggtttttctgggtttttctgaagcacagccctgagatgaattccaagactgcagtattctcagtgacaaagggtgcagcaatcccttaatgatgtctgacttgggagagggaattagaggcgtgggtgtcacatatttgctatctgtgccaaaaataaagtcatatattaatagaagcccaaaatcaataatttacaaatagcttcctcaaactttcaatggtacttctggaaaagtgagatttgaaattttactctccttcctttgcactctaaaaatttattcccctgatattacttttatattaaaaactaattagaaaacttcataggtttcatcatatatttaacatcattgctaaagttctaacactatttttggaaatcatcaaaagagaaaagtgtaagacagacaaggaaaacagagaagttttccatgtttaatattataagtcaccacaaagtattattttgatattacaatttttttttttttttgagacagagtcttgctctgtagcccaagctggagtgcagtggcacaatctctactcactgtaacctccgcctcctgggttcaagcaattctcatgcctcagcttcccaaatagctcagattacgagtgcccaccaccatgcctggctaatttttgtatttttagtagagatggggttttactatgttggccaggctggtctcaaactcctgacttcatgtgatccgaccaccttggcctcccaaaatgttgggattacaggtttgagccactgtgcctggtcttaacaaattttaaaaatagtgataggcaaatacatctaatgaaactagagtattatttgtcatttctttggatgaaccaatgcatgtaaggaggatgtagttctgggtttctcctgtttcatcacacagtaacccaccgtggctctctcctccatgccgatattatataattgtcaaggcattgagacagattttaattcatttaataattaggtcaataaaaaccattattgctgacagtgccattaaaagtccataatgtcaccttcatgggggaaaaactaatatagttccgttggattttttccgtgaaattaatatgatagcatttcagtgggtgtcttaaatagcttaaatagacatttttattaacagaactaatcatagaattaaaacaaatgaaaatcgttacatttgctgtgatgaggtatccatgttcacaggattttatcagcctcattcctgtgaagaacctgaacatttactaccacaagaacagtatattcaacttgcctggagcactgcttagggtcccaaagaggctgcccatttgtgttttggtgatttcctcttcaacaccatggctccatttctcagagccaccctactgggaaacatgccagaaccataacctcctaaaccaaaaaccttcttcatgtcccctttttggctggtagtatttcatctagaatatctaagacagtatttcagctcagaaaaatactaaagcagaaggggttgcacctacgccgcccagcaatgttttatcacctctccttcctcagcttaatcactaacggtagatagatcttaacatgaactaaggtaaactctagtatagtgctatacgatttaggtaaattctcactagaagagcaagatagcaggaggaaagaagattataccaagagtttcctctcagacacatgaatgctatggttctgtgagttattcaaatgtgcaagtcactgtgtatggctgcatcattgctgcttgggtacctacaactcttcataatcagatataccaggattcacaagaattcaggggtggtcaatattgatcaaaggccaaggccacagatgtagctagcacattatacactgacagaacgcttgctaatgtacacaaagaagtagcggctggagcctgtgaggctgtgcaaacagtataggctttgggtttgggaagacccgcattagatcttagtaacttggttcccaacaggatgaccatgggcaggttagctcccttcagttttcagtttcagcatctggaaaatggattgatgaagtccacagttgtttgactctgtggtttttaggatggttcgaaagagatttcagatgaaacatatctaacaaacactgtggctggcagagagtaagggctattcttcagaggaaagagtcatctcagttggcattggacgtatttaaaatatgattgggagggtagcctctgctaacctccagccacgttggtgaactctcagaaagccttgtgcatgcccagacatgctgaatctaaacaaaccaaagggaagctgcacttctccactgattactccctttcctgccctttggaagattctagaaacactaggaaatctacttaaatattttttaactcagttttaaacaacatctctcagaaaataccattcttagtagaataaaccttctttgaaggcgtacatagacttacatatgtgatatttgcaaccaatcagcattttgggtgactgggcaggtcttgggaagtgggaggcacagtaaaaatgaaagactttgtttgacctccctgagttctaagcaagatgtggtgcctgagaaagcttatgcaggtcctactgggcaagactataaagccaagcgcaacagagaaaaaaataccttagggcacggacgtttggtttctcaaggcctgtgatggggaaggccctgaaactcccctaacagggatggaagaaatctgtggatattttgttcatgagaagtagaggaaaaggggaggggagaaagtggaaacagcaacgtgtctggaaaccagctggcacctgtgccttgaagtaaataaattgggtaaagaaatatgatagctagatagtcctagaaatgaacatcctgaaatcatcccataaactttattttggagggggatagggaagagaagagaccctttcttccatttatttcatttagttggtgatattattgggcattaacttgggattcactattcctgtggcaagtacttacctttgctgaaattaccaaatattctctgaaacagactcttatcagaaaattgatctataatacataacggtgtcttgcaagaaaaaagtcccttgtgggggcgattttttaaaatggttcactgcaggcctttcacaatcacatggaaatttggagattgctcagatattgtgggaagaggagaaagggaacaaagagagacataatacttgagactttacaggctcctaccattttctagtctattcgacaagagcagcagaggttcatatcaaggaagtgaaaaccattcaggaatacaaaaattgtttacaaaaaacagcctgtgctttgcattcttttctgttacttcgacaattgccaagaagtgtaactgtgcttgctcggtattatttaaattaaattatcaaatgcaaatgctaaatatgaacctctcagcaaagcactgggttataatgccatgtcctctattcagactaaaagctgattactggttctggagttacaaacatgtcagacaataatttaattgctttgcaggtagaggaatatgcagcgttcttgttctcattctggaactcaacacgactctttaatacaacataatgatcataaacacacacaaagtcttcgcctcacacctgctttatggtaaaaagaagctattgcaaatttctgcaaagctcaaagaatgaggcagtgccagattttttaatcactaagcaaaacaggtttctcaccaagtggcccgggcttttactcctggttcagagagttacaagacacattttcaaaatgagtttaaagctataatgaatttcaggtgcaaaggaccaccgtctaacagctaatttgcttcctgtcttcaactgagctgttaaccataggcagccagcatgtgcacccctttcttgggccactggtgaagacagatgtcacaatcaatactcattaactctgggatcagtgtgtatcttcctcaggaagagaaagggggtcttaaatgtaactaggaggactttgtaagcattttctgagcattgcagtggctgagtgttaaaccacaacaggacaggagtgcaggagggggagagaagaaaggggagggtgagagagggaagggaagaagaaaagaggccacatttcgtgatctcctctgtctctggagctcttttttatcagctcgtgaaattcccaaggatcctgatcatctcccccttcccagctcatcgcaaagagttgttgtacatttctttgcaattgggtagggaaagatcttgaaaggtggatccaacttgaacattagacttttgtgaaacatgatacagaaattgtagtgttgcagagctgtacctgctcatttgctgactatgatgacccaacatttattgagcactgtatgccaggcctgtgctacctcaatgcttcacctggagtaccttatttaatccttatggcaatcccataaccctataggaagcagtcatccttttatatatgatgcacataaaactgtctgaaatgatttgcacctaatgtaatgatggtaggcttaaatgctttcatttttgtactttgctgtgttttaacaagtttttgtgatggatttgttcttgtttttgcaaaatcaagaataacttaaaaataaaagactggatgccaatacaaatctcccaagatgttaaccttggttaattctgggtgatgagaacgtagatgattgttatttccttctttgtacatttctgaatgtttagtttccctatataagtgaaaatatagactttaaaaaagaaaaacaaaagaagaagcccttcactagtgccacagtgtgaggagaatgaagcctaagcctaaattttattaaacagcagggtgacccaatgctctgtatcaatgctagatacaccaccaagcattcgctacgcataatcccaccagctccttccaacaactctgggaggtaggtgtcaccaccctcactgtacagacaagcagagtgaggtttcgagtgggtaaaggaccagcacttgaggtcactcgggtatctggcctccacttacccttctggcctgaggctccatggcatgccctctgacctttgctcataccctggtctccagccgcctgagtccttgtctttttctgaccacaacctcaaagtccctaggtccatacctaatgttcacactctctcatttacttggaaagccattttccagactacacccattcttccaaacgtgtatcaaatactcccccttccacaaagattctctgagtcacctcagccttagtgtattcaccttggtgtagtatatgccacaggctgccacatggcaggtgccaggccagctcaggcacactgaatgctctgtatggcttatgcagtgtttaaaagatttaaaaaataattagacttgtattaaaaaaaaaaaatgtgtacctagtggctcaggttcccctaccctgcttggcaataattaactgtagccaaagcgtctgccctattcagacagaagcctgtgtgtgctctagttcccaacagtttccttttaatactccttcttatccttggcccatttctcttaattcattgttgtcaggcctctgagcccaagctaatccatcatatcccctgtgacctgcacgtatacatccagatggcctgaagtaactgaagaatcacaaaagaagtgaaaatggcctgttcctgccttaactgatgacattaccttgtgaaattccttctcctgactcagaagctcccccactgagcaccttgtgacccccgcccctgcccaccagagaacaaccccctttgactgtgattttccattacccacccaaatcctgtaaaacggccccaccccatctgccttccttgactctctttttggactcagcccgcctgcacccaggtgattaaaaagctttattgctcacataaagcctattggtttggtggtctcttcacatggacacgcgtgacaattgttttatgtgcccagcacatcacaggtgttcattgagggccagaaactagtcacttcactactgctataatcctagggagagagaatggtggtctgaattacaagcagtgagaatagagaaaagatattccaaagaatctgtcctctgaaattaggggctttatttatttattggaacactttctatcttgaactgtagtgatacgggtatacatcttacctattctacttgactgactgcatccccctgaagacacgtgtcaggtgccatgcctgccctgtgatatccccagcgctgcctagctgaatggtgcatacataccaggcacgggatgaatgttggttgactgatcattcattttaatcctgaaacctggcgtttatgtttccgctacatttaaaagctggcaaaacacatctccttccctcccactcactcaattaaaagctcagtacattaattatctgaattaaagtcaagagtctgagatatccctcccaatttataaagacagggacgaggtaaatttttttcccaagttgtagggacagaaagaagactaaagaatgaggaccttacaggcgagcacggggccagcgaaggattctgttttaagatcatctcctggtgctcattagtgctgttgctcttcacctgggtgagcgggcttgcttccatggagaagagacctccgccagctcctgctgcattaacggtctccgaatgtgatttggcggcagcacgggtctcattagagtgggggatgtgcaaaggcagaaggcctcactttgagaaaacactttgcgtatgaacaaaggtggaaagatgtcaggcttttaaagggaacctgcatctcgctcctcacttagcaaagtcatcaggagattctgctaagtaaagaagttctggaccttttcaagctattaaaggtgacccaacaaagcaaaatggctttgttccccaaatttctttttgtcagttgccttgaacaaccaagcctgaacgaaacagcctaagggagattgccaggtaataataaatccctatttgcttcagtaaaggacatctcaaagaagggataaaataaaaaatatcagaattaaagaggcacaaaaaaccctgaacatccggggcatgtagatgctcggtagcaatgaatgtattaggttggtgcaaaagtaatagcgattttcgccattactttcaatggcaaaaactgcaattacttctgcgccaacataatacttggggcctggttctcaggggtagggcttccagcattttaagtagcagtctgccatcaggcaagatgtgcatattcatcattgatgtggcttgatcatgacatattctgttttcttgagcaaggaaagaactcagcaacatctcgcagagcgaccatcaggttatgtccttgtctctggttcatttgaggagagtaggaaattatgaaacccacaagaagagtttatggctcctcctcacactcctacacttaaatccaggaagagactgccaggcgtcggtcaagtttgaagatatttaatggactatgcattatctacactgccccatttcaaggtcaatagctgtctgtctctttatcccataaggctaggttttcccttgaagaagaaggtactgctgttactggtagagggtgcctatgttcttggcatcttgaagaactggacaaaatgcgcaaacaaagcaaggaaagaatgaagcaacaaaagcagagatttattgaaaatgaaagtacactccacagggtgggagtgggcccgagcataggggctcaagggccccgttacagaatttttgggggtctaaatagcctctagaggtttccattggttactgggtgtatgccctatgtaaatgaagaggatgaagtaaagttatgaagtcatttacttggcgtatgccctatggagaggatagcccctgtcatagctcaagtgtgaatcagccttatgttccctgcctgcagaccctattttcctgtctcactgccacttgggtctcctgagaaggccctttgctgactctgccttctgggaactggcaagtcaggtgatctctggagctgccccacggtagaaagtgcagagcgaacagccgaggactgtcatgcactaagcatttggggaaaccaccctttctcccaggttggtgggctctctcgagacaggtacctgtacttacttggtattggagtgctctaatcttagagtctagtgtaggcttcaggggagagggagctaaggcggccattctgtttgctttgtttccaggccttgggtttgtctctagagggagaaagagtcctcctctgtctagcttgaagcagtgggaggctgtatggggcacggaataagaaactcaaagtgtccctttccggcgtgtcctgctctgtgggcacttactccttcagagcttgtgaagacagagataaaggtcagtcaagcccaggaccaggtgttgggattgttcttatccccaagttttctaatttcactaggaatattaaaggcaatttaatgcaatctgcattttaaagataaaagtgatggagttcaggacatgcttccccaaaatatggcaccttggcatagtgaatattttcagctaaaggaatgtgagaaggtaacagaagtaggaaggtctttctgactgttcgctccctgtttgtccttgcggcaggttagaagaccctcattggagaggtgccctgaagaaaggaatgttcttatctctgaagacaaagggtcacagagaagaatctgaacaaaactctgtgctaagtgtccccagtttattgccattagactacatcctttttgacctagaagctccaccttcaaagtttttaggtagccatgaccagtctaactgtagaaatggaatggaacattggaaagactgtaaacttggagctctaagaactaggttcagtttcctccacttatcagctttgtggccagagtcaaattttgcctctctgtgcctcagttaccttactacaaaattaggactattctgaggcttcaatgagggttaaccatgtactgagcatgatgctgggtatgctactctgtagacactacttctctcccctctcctctttggtgacttttaaagatcatggggaagctgggcgcggtggctcatgcctgtaatcacagcactttgagaggccgaggcgggcagatcacgaggtcaggagatcgagaccgtcctggctaacacggtgaaaccccgtctctgctaaaaatacaaaaatttagccgggtgtggtggcgggcgcctgtagtcccagctactccggaggctgaggcaggagaatggcgtgaacccaggaggcggagcttgcagtgagccgagatcacaccgctgcactccagcctgggagacagcgagaatctgtctcaaaaaaaaaaaaaagatcatggggaataatctacatgaaaatggatgttgtaaagcctaggacattacatgtgttatgtggcaagaggggtaaatggtagagttaatttttaggcctctcttaagcctcacaatggttctaattttgtaataaggtaactgaggcacagggagacaaacacttgactatggccacaaagctgataaatggaagaaactgaacctagttcttagagctctaaatttatactctttccaatgcttcgttccacttctacagttagactggtcatggctacctcaaaaccttgaatgtggagcttctagatccccagcggcaattcccatcaaggagaattttgcctgcttgactctctcctaccatccacagtcattgttactgcaagtgagttaaagcagttgagcaaatcatatatatatatatgggtacagggtttatatatatatatacatatatatgtatacatatatatgtgtatatatatgtatatacatatgtatatatgtgtatatacatatgtatatacatatatatgtgtatctccccagtgtatggggttagaatgcagctgtggaacatgggggtgtcctcttagtgactcaaaccaaattatcactggagaaacaatgagaacaacaaaatcaaatgcaaaccaccaaaatacaagtgtagtcctcatatcaagaaaaagataagggaaagatcttcagaaagcccctctattaattatttagtctcagctcagacagttccagaaacagaacagtgataaacaggaccattgccatacttctggagatgaggaaaacaccagaatagaaatcttcagtgggctagtatgggactctggctgtgatccctctcttatccaaaattctgctaagggacttgcctgagaacacacacagatttctctatgagagcaaaataagagatatatacataggttagataatgcaatgaagatcaaaaattacattttggaatgttgtattccatcttatggggcagcatttaatcaggatcctagtgcaatcttccatctggagccccaaatccaatgtcacacattgcgggttggggtgcggaagatctagcttaaccctagtgaggaagatgtcctgcctggttaacttccagctcagtgggtattagtagcatagcagggatgccaaacaggaacacactatggggtgtcatcagcaagaataaggtccagagctatgtggtgggttagaagtctgaaagtcagaaaaggctttggaagccctcttgtcttccattttacaggtgaagaaactgaggctgaatgatttgtttaccattcaggttacacagagagttaaagtcaggacccagaccttccaagtcccaggccaaagcaggtgattattctgtagcatgtgctgtccatattcctcggcagcagtatatcccagcagcagcataatttcagaaaaggaatgagaaaaggggatatatccattggagggtacccaggatcaggggtttcaaagatgcacaattctgggacacagggtgagtagtcatgagaagtggagatatggggtgggggtgcgtgatggtttccgcaaacacaggagaaagaaacattaacaacgtgggccgtggaaaaggaattaaacttgtttggtttcatggagcaggtagataactagtgggtggatcggaagaaagcaatttatatgtctgtggtgaaacatacacacataacgtaaaatccaccatttagccattttaaagtatatcgttcagtggcatttagtgcattcaacagtgttgtgcaaacatcaccgctacctagtttcagaacattttcattatcccgaagggaaaccctgcacccattaagtggtaactcccctttcccctacccccccagtccctggcaaccacttatctgctttctgtctctatcaatttgcctattatggatatttcatagaaatggaatcatacaatatgtggcctttagtgtctggggaagcagatgcttttttaacataatgaaaattgcaggatgaagagtgtggtttgaaagggggcttggtaatgacttaggatgcttgaattcaggccaaggctagaagtccacatggtagggatattgcggaggggcctctgaacaagaagtgggcttgaaaggctggctcttcagggcttttctgacctggagatggaggccctctctgacaagcccctgggactatctccctttttccccacaaccccacctctgccagtgatgaccagtctctaccctacggtaaaactcaggtccaaccacgtccactccttttgctaatttcccctcttttcattctcctcccacctccgggtctgttgacacttgcttgccaatttgcctgacacactgcagacaatcttctcactcaagcatgtttgacctgaacatacagctttctgctgagctgatctggagtttcagttggccgtttgggcagccagacatgaattaagaacagggataaacaaggatggcttgagctttaactacaccgatttggcccaataggctcggggataatctataagacctaacagctgagggcaataaaattagctacaaagggactgcggggtagaaacaatgtcttctgatacttcacacaacacacactcacacacaaaagacaccaaaaactctccgacagaagccttacaacagcttagaggagaggcattgtgcttgaaaaactatattttaaaaagcagagaggaaacccacggtgactgaagtatcattttcccggtggtgatcatggatttcatcccaagacctggaaatcatgttagaactacagtatcagcccagctttgtgtctagggcttaaacttgaaatgttgtttacataaatagttaaggaacacatactgggttgaagagtgtgctctccaaaaatgcatgtccacctagagcctcagaatgtgaccttatttggaaagaggtcttgggagatgttattagtcaagatgaggtcatactggattagaatgggccctaaattccgtgactggtgtccttataaggacatcaacggagggcagaaggccatgtgaagacaaagcggacactagagtgaatctgctgtaagccaaagaaggccaaagattgcggaaaggaaggattcttccccagaactttcagagagagcatgattctgctgacactttagttttggacatccagcatcttgaactgggagggaatgcattttggttgttttatgccactcatgttgtgccaatttgttacagcagtcctaggaagctaacataatacactcccaattccctcttcttttatacaattgtacaaccctatttgaaacatggaaaaggctcttagttctcacaaaaaaatctcattatatttggagttcaacttctgaacacgggtttagaaacaaatagggtctgatttcactgattttcaaagggctttctttgtaatgactggggtttgttttatttgtttgcttgtttccaggagaagagaagattggcctcagacacttccgtcttcagacctgtgcctctcctttgaggatcccttccccgaagctgccaaggagaaccttccctcacattgttcctcctttgttccccgctctccttttccaggctgagagacctggggccttggaagcaagcacacgctggctgagctgtgattcctccatgttgattataatttttatcacattatatgggatccctctggtggttactaggggatacgtcagttttgagagattggaacctaaccaaagaagcttcaaatctagaggataaggggactcagagtttacaagtcacagcaagcagatgctggtctgctttaggtgcctcttacggggattgtgagagggctcctggggcctgaggagggtcttctgaggtgtgaaaggctgtactggtggtccctgaaagccatcgtcatttgtgtgaggaggagtactggaggagctgtcttaccacatgaaaaacagcatggagcatcccagccacatcaaaggcacggtttgagccttgggctgtagaggctcagagagagtgacaaataagaccctggtgagagaccaatggggacagtatttccagactttggcatgaaacagatttctgagcacctcatgaaatgtctgcaagggcagctcctcagagtgaccctcccaaatcaatcaaagctggccccctatcttaattatgacttacaaatagaagcatgcacctggctggatgcagtttgccacatggtttacaatagcggtagaataagaaataacttaccaaacgagtacattttcttggctggctggggcactcagagttgacactggtaaggctccattaaaatgcctttatgttctgatatacacagatgtgttaatttatagcatattcatcagaagacataaattaattgctctctgatgaattttataacacctcctttatgcctctccaccctccccctccaaagtacactgaaaaggtcaacagcactatcgaatgcagcacacttcaacttccttccaagcttataattaaagctaattagtagctttggtaattagcgcatgtaagctttctgctttctgaattaataagactgagtcaggttttgagccaagtagacttttcactcactggttctgattcttgaactgtgtttggctggttaatttaaaacatgtctgttgaaagtggaatactagaaagaaaacatacttgtgatggtctgctctcaagccagtgtgatttatgaacaggccaaagtggaactgttgtcacaagagaaaatcagaatgctctgggtttccaataactgaccagtctcaacctctcagtgtgaaatgagttgtgcccagttactatgtcacatggacacaacacaacgtcaaggatgcccttgcacacttatgtcaccctctcataacacatctgtactaagcacatcaaatcctctttattttaggagaatgcagaggcaatggcagtggggtgccaagatataactaactgctcattttgattcaaataaaaatcaaagaggagaaaaatcattagtcaaatcagcttctgcttttgtgtagacaaagtgattctccaaatagcttcgtgtttctttttttagccagcatgtgggcatcctgcatgcccagacagaattaaaagtgcatgttttaaaatcaagaaatcaaatctatattctattaaaagaaaaaatgtgatttgttttcagactttagaaacagttgggataaaaatttccacgggtgagctcatttgctttttcttttcccatactaatctcagaaaatttatttttgttttttaaagaaagaaaggaaggaagaaaaagaaaatcacttagtgatttactggactccttataagtccaggacaatggtgggggttgctcacagcgctagtaattttgatacataaagaaaaggaaacagtcactgctgcagagagaggaatatataagacagctctgggtcactagagtaaatggttttcattttaatggcgcacttactgccactgtgatagccacatttggatctgtaaggggcagttaatactattcaagagcaaggcacatttggtcttgtggatggctgtgattgtgaaggtgacaaggggttatggattcccacagcctcacaggcccagctgaataggaagccttgtgcccccttggcagctcatcctaccccgtggcagctcatcctacctaggtggatacactccagtaagatctatacacagtggttctcaactgggggagattctgcccccaggggatacttggcaatgtttggcacagttttgattgtcataactggtgggagagggtagatgctactggcatctagtgagcagagactaggaatgttgccaaacgatcagccatgcacacgacagtcactcctcaacaaagatgatctggccccacaggatactagtgccaatgtcatggaaccctgatacagaaggtctaaacagggtctgaggccctccttgtctttgaggaagagttaaatgttagctttccagattgactctggactgatcttggccttatacaagtcagaaagaagtgagtgatagctcacccacaggggctagatctgagtcagactggaagaagtcggcacactcagggtaacggcagctgcctaaaagccaagcgctgggcatttttatgttgcagctaaggccagcatgctgcattatggatgagctcatgtgccatggcaaacagtttaagaacgatgcttatatttaatgaatcctaaatggtttattacagagggtcaagtttctgcttcctgtgggaatttgacatttatgaaaatgcacgcacattaattattcagtggagacgtccttcctatggaaattcactttcctgtacactcgacaggactacattccctgtctgcatgggctactttgttgttaatcctctaagcattaattaaataaaatttgcaaccgagccaggatgcatctaccctcaaatgttatgcaaaagacagttaaatgctgtttgatttttcctgctagtagccaatcattacccatagctatttatgttcttccttttgttctttaaagcataaacctggtatctcttcccactgagaagaaaactacgctcagtaattaaattacaccacattaaacttacttaagttcaccagcagggaaaattccgtgcccctgggtttaacagtaagtcctaatcacgcttgcaagccatatcttttctgtgagttgttatagttttcattcctggaattccattaaaaatggtaatgtcattactcctgttactgctcaaaaccaacagcataatcctgaattttaattagtaattacaattaatcattatttcattaatgaaatgtttagttggtaattgtctttgagcaccttactccctaggcttataagcatttcataacatctaatttgttgcctgtttctgatgaagtggcactgtcaaccttattttatgttaacactttgatggggctctgcatcccaggcctgcaccaccggctgcatatttacaccttggaaatgtgtggcttctggctctcgataaggttcgcctgaggacgtaccctcgcattctttcctgccagcttaagaaggcgactgtttgtgctcccagagagcacagcatgtgaagagagaaataataattcctggaacgcttacttaataataaatctgggatccaaattcatggatttttgagaggggatagagcaaggatttggaggtagtctttggaacaggaaggttgattttaaaagagcttaaagaattaagaataagctgggagggttgtcaagaatttaacacgaggcaagatttttgttgatccttttgcaatagcaaagatattcttatttattaggatggttttttaggggtgaggggaagcttgtcttccccaccaaaaggtcagggacccaagtatgccttgcacacagttgtattcctagctcctggtgcggggttgggcatacacgtgactcaataaacagctagataagtcattgttcctgcatggcctatggttaggctatgaagggggtaactgaggtacaagagttaatggtggtttggtgatggtagcagggtgtgggatgctaggagatgccaaatcagtgggctggtgtgctcacaaatgacctgatgtcatagttgtctgtcactgacaattctaaaaggacggattcatccgactgccctctatgtaaaaaaatttacacatacacacacacacacacacacacacacacacccgacggtgaattattcagggaggagaaagcctgctatccttggcaaattaaacaaggaggatttgagcaaagaaaagatgtgctgctgttatttcaaggaagtattcacagcttcagaattaaaactgagatggaacaacatcagacttgttggaaaatgctccgcgtctgtggtgtatttcagacaagttagtcagaaaattcaaaatatctggaagaaataaatgacggccaacagtttggtgttggccaccaggtgccagagcacgtatggtcttggcctaaggtgagtgaaagacaggtttctgggtcaagacaggtgtttccaaatggcaatttttgaggctgctgacattttacaaaataaaagaatgtgataaagcttaagtttttggttgtattttataaatgtctatatttaagaagttcatgctttagcacacataagacattcaacaagtcatttggaaataacatcaaatgtcgaaatttgagaccctttataattaggagtggaggaccaagtggactccatcccttgtccccacataggtcctatttctttcctaggccacacagcttttaaacataatatttctcccctattatccttcagtatttatagagcatccggcctgtgctaggagcttgaaaagacagtccctctctcatggagctcccaatatagaggccctttccctttggactttcttctactggaaattgccttttcttgtgtagttccctttgctgactctgcttgtcctcctgttctcacaaaggctaccatgcagtgggggaataaatatgaaaaaaaatataagatcattgcactgcagagtgaaggagcaaatcccttaacagtcatgagtacacattccagctcatgagcataaagccacactattcatagaaatgggtgatactgattgtacacttaccatgtgtgaatattgtgcttagtatatcacatggattacatcacttcacctgcttcggagaacctggattgagcataatggaaattaagagttggcccatccctagatccacatctgttacctgctttgctggctgcctgggaatgaggtcttgtctgtctgttttttgtttttttaacttcagctttggcctggagctgcagcccaggccactatggaaggaaagggaatgtagcctttataaaatcatctatagcctggtgggaatgtcaactagtacaaccactatggaaaacagtgtggagattccttaaataactaaaaggggaattaccatttgatccagcaatcccactgctgggtatctacctagaggaaaagatgtcattatatgaaaaaaaatacttgcacacacatgtttatagcagaataattcgcaattgcaaaaatgtggaatcaacccaaatgtctatcagtcaataagtggataaagaaattgtggtatatatatatacaatggactactactcagccataaaaaggaatgaatgaattaatggcattcgcagcaacctggatgagattggagactattgttctaagtgaagtaactcaggaatgaaaaaccgaacactgtatgtcctcacttataagtgggagctaagctatgaagacacaaaggcataaaaatgacacagtggactctggggactcaagggaaaagagtgggaggggggtgagggatgaaagactacacatcgggtacagtgtacactacttgggtggtgtgtgcaccaaaatctcacaaatcaccactaaagaacttattcatgtaaccaaatactgcctgttccccaataacctatagaaataaaaaaaaaatttaaatcagctagagccaagcagaaataataaggaaagtgaattccaagaaaaagtatggaattctcttcaaagcataacagaaaatgttttgccatttctggttgttgtcatgaagcaaaaaaacccacttgcccacttggcatgtcttacctgacaaaaactacaaagaaaggcctgcccagggtttctgcaagtcctggatctgggaggctgtgtctcacagagagtgacagccaagactgaataactgtgagactgtgggcaagctggtgagttcttctgtgcctcaagttcctctatgtaaatggggacagtgatccttgctcttgggcttgttgggaggattccatggaatgatatgtgacacctggcacacagtgtacactcagttatcatcacatatgtcatcttcaatatgatttttgccaattagatgtggactttttgcgttcattaaaaatttaaacaaacaataataacaacaatcacagtgagtttgggtttataatactgtggatttcttccttggcatgattggagataaaagaaggaacattccatgtgatgctgtgaggtcccaggaaaggtgtgacagagaatcctgagtcatgcttacctgtcattactagtgggaatgagagccatctgggatgacctaagtgcatattgtttgcagacagtgataggtgctcagggagcaggaaagtggagcatgaactcacaatagaaggtaggagcagagacaatcaagtcctatcctaccagatcaactgagagatttctattccctaaagttccacagtctttgtacccctctcaccatgtcaactttgctctccttgaacgatcttatcccctctcttgaaccatactccctgtttttctcacatttacgtccccttcaggatatggcaaattgtcttatgctcaggaaacatttgctgaatgaatcctctggagatcttcagaaaatcagcatattccaaatgaagtgactgagacttaagcaagagacccagggtgggatggacagactcttgaatagcatcttgatctagaccagtataaactcgtgggacctaaacaaaagtggacctttgttcagtgaagaagattcccagggagcaggtagaagcagatggagctaactccagatacaggctgtgctctccgcagaccccagcgtcttcgtagataggaggtttagcagatggtgtttttgcattaagtttctaaattaccatctataagatcctctgttttctaaaaactagttgccttaaggctttaagattttaatgtaattttaatgtttgtgtgtgttgttagtgtacctgtttctcaggtttgctatcccagataggttatttgctaagatcagaagaaaatcaattggcaaaagaacatgctcacatgttacatgttattaccagttggaacaagagccatctgggatgtaagactatccaccaaacgggtgtgtggaactgtcccttggcattgcacaggaggaccacttttagtatgatttcctgtgctgtggctatgacatcagggaggctgaggcaggatcacttgaggccgggaggtcggggctgcataatgagttctgatcgtgccactgtactccaccctgggagacagagcaacacccgtcactaaaaaaaaaaaaaaaaaagaaagaaagaaagaaaagaaaaaagaaaaagaagaacaaattcagaagctacaataggaatagttcagaaaccatcctccagccttttaaaggcacagaagagctttgtttcacattcgtttcggcttccaaagcaactagtcaagtcagtttcacctgttttattcacaacagttatctctccaatccagattccttctttaaaaaaagggaagaaaaaacattctcatatttcttgttttgctagcaagaaatgagctgcagaacactttcagagatccactagctgttttccttaagctgaggctgagagcttcaggggcactccaaagaaagaaagaaaggaaagataaaacaaaggacgagaggctggggggaagaaagagaggaagggagggagaaactatagagaccactgtgtggacacccacaacttctggttctgaggctggtgggaaaggaatttgcaatagaagaggaggggaactgagaggagagcactgtattaagagcttataggaattctaaaaagaaaaaaaaaggaggcctttgatccattccaaagagggaggcagaaaacttcaaagcagaataacagtcccctgcactctgccctactctaagtacccggagcattcattatgaatcagcccacctcccctcggcccacgtggggctgtgcaagccagacacgcaattcagacccacagcttgttcagcctccccgagaacacagcgtgtgcaaggtttgggaatggaaatatagcagggtgcccactcctaagtggggttaattcacggatgtggaaggaatctctacctttcgcagagactgctagaaacaccagcttcccttctttctcttcaaaggaagatggtgtttttttctccttaatcctgagtcatttacagtaagatacacgtaaataatagtccaggaggtaaaatgtgatctacacagtctctacctcaaaaataagttttttgggggacttgtttaccattccgaatgtgacccggcagccctttacaaaaagtaacatttgcttttattagatacagcagatctatttctgtgagcaccgcagatgtaactgggattcatttttactggatgtctcagaagaccgggccgactgccagctctcctggacacaggaagttacagggtgcggtcacttctgctcacccatttctccttcaacagcgcagatcacatgcacagagttcttaggagacaggtcttccccaaggcaaaggcacacagaaatgctttccttcccagctgccccttgatgaaagaaactaaacacctcttcagcatggatatgacactagccctcggcttcttattttttgcaatgactactctgtgtcagagtcagtaaaaatcgcaatgcagagaagagagataaaaagaaacatcctggagaattctcctggttatttttaaaatattgtctctgttgacttgaagtggtgtagaaacagttccatatgctgtgtttcttttttcctgttgcatcttatagtttaaacatagatcttttatcggatacaacttctgttaacaatatggcctactgggttagcaaagaaaccgttcttttcttacagttctggatttggggaggttgctcacatttaactgtggaaagcattatgctcttatggtctttgccaattcttttctgtaacacaaacctaaattacataccaatttctcgaggttcttgcctagtttggaccaaattaggtcccacaaattcctgatcttagcaactgtgtctctcagttattttccgtgagacaatatgtttgtctgtacttcatattgctttgtggagacaattaccagtgctatatccctatttttctttttcttgaaaaaaaatttaatttttagaaattatttgtataggaaaaatgttaaaatagaaataagaatataacctctttgaccaccctgctccagtcctggtcccctccctggaggtagccgtattagcagacaggctcgtgttcttccagacatttttctgtatatttgcacacatctaaatacatagtcatatgtcttgtttttgttgttaccatcattatacaaatggaatcataccatagaacagatgcctcataatttatttacctattcctctattaatggatgctacggtctgaatgtatctcttcaaaattcatgttggaacttaagacccaatgtgacagtattaagaggagcctttggggaagtgattaagacatgggggctctaccctcatgaatggacttagtgcctatataaaagacactgaagcaagcactctggtcccttctcccttccaccatgtgaggacacagtgtttgtctctttcttcctgtgaggacacaacaagaagactccatgccagaagcagagggcaagccctcaccagaaacccaatccgctggcaccttgatcttggacttcccaggctccagaactatgactaataaacttcttttttaaattacccaggctaaggtattttattgtagaaacaggaatggactaagacaatgaatatataccttgcctgttaatttgctgagaaccaaggtttcattttcaacatttactagctaatctagcctagagaagtacaaagaacccaggacttggattttagtccaacaatactactaatgtccaggtaatcttcggcaaatgatcatcctctttgggccaacatatcctcagctgtcagaccagtgggcatgtacagtgaacaacttagtaccaggtactacaacaacttacacatgcctaggccccagggcaccatggtgattctgattcaaagctagggctaagattggctacccttagcaaagaagagttactgatgtgtaggtgagaaaaatgtctcacgatttagaacaggatgggacaaactacatcccatgaaccaaatcagacctgccacctattattataaataaagttttattggaacacagcaatgctcgtttgtttatatattgtctttggctgctttagtgctaaagtggcagagctgagtagtttcaacagagatctcatgactcacaaagcctaacatatttgtcactgggtaccttgcaaatgtttgcagacctctgctttggaaagatccctatggtcacacagagggtggggaaggaagacaatttagagtggtggtggtgatgggggtctgagtcagggcaagagaaaagaacaatgtgcgagacacaacacaggcagaagcacagaagttgtgactgactgaatggataaaagtatgagaaacagaagttaccagtttcatatttccaacttggaggcttgggtgattgtcattaaccaagatgagtgtcatgaaaggaaagaagatgtttatgggaaggtgagtaagattcgaattagggactttctgaattcaaagtgcagataaaggtgtccaggaagcagttggaaatatgagtctaatattcaggagagaggtggggctggaggtcaagcttgagcgccaccatcttggagatgagagcaggtttcaggtgagcagaccagaccaaagagggaaaaacatagaggcaagatatttgaggaagaaattctgagaaaccccaacagttaaaggactggcaaaggaataaacctgagaaggagcaatcagaagagtagaagaaaacaaacatgataatatttgtgaaagcagaagcaactgatgttggcttttataagaggtctttgttgggctcatgtcggggtaaagagtgctctgaggatttggtgcctcttgtcagtgtcctgtggtggcttccatagaaaacactccacacccattatctgcaaggagacagctgcagttttgcctcttcatgtggtttcctcaaacccaccccctgggaaatgcaatatgattctctcacagagcagatgggatgctaactggaatcacctctgccttgcagagttctccctcagttgctccaacagtgcctggtagtgtaaacaagactggcttaccagtgcagcattcaataccagtgcttacccagcagccattcaaccagtcctgctgatgccccaccatgtgccagccaccaaagcatctagtgccaagattacaactgtttccttctgctcctggttcttagagtttttttttaaaaaaaatatataaatgatctgcatttagtgatatatttatttttaatttttttatttccataggtttttgggggaacaagtggtattcggttacatgagcaagttcttcagtggtgatttgtgagattttggtgcacccaacacctgaacagtatacactgaacccaatttgagtcttttatccctcacccccaccaatgctttcccccgagtctccaaagtccattgtattattcttatgcctttgcatcctcatagcttagctcccacatatgactgagaacatacaatgtttggttttctattcctgagttacttcacttagaataatagtccccagttccatccaggttgctgtgaatgccattaatttgttcctttttatagccaagcagtattccattgtatacatataccacaatttctttatccacttgttgactgatgggcatttgggctgtccatatttttgcaattgtgaattgtgctgctatgaacatgtgtgtgcaagtaccttttttgtataatgacttcttttcctctgggtagatacccagcagtgggactgctggatcaaatggtagttccatttttagttctttaaggaatttccacactgttttccatagtggttatactagtttccattcccatcagcagtgtagaggtgttcccttttcacagcatccacgccaacatctattactttctgatttttttttatcatggccattcttgcaggagtaaggtagtatcatattgtggttttgatttgcatttccctgatcattagtgatatcgagcattttttcatatattttttgaccatttgtacattgtctgttgagaattgtctatttacatccttagcccactttttgatgggattgtttgtttttttcttgctaatttatttgagttccttatagattctggatgttcgtcttttgtcagatatatagattgtcaagattttctcacactctgtgggttgtctatttagtctgctgactgttccttttgctgtgtagaagctctttagtttaattaagtcccacctatttatctttgtttttgttgcatttgcttttgggttcttggtcataaagtctgcctaagccaatgtctagaagggttttttctgatattatcttccagaacttttattctttcaggtcgtagatttaagtccttgattcatgttctgttgatttttgtataaggtgagagatgaggatccagttttattctcctacgtgtgacttgccaattatcccagcaccatttgttgaataggatgtcttttccccatttctgtttttgtttgctttgttgaagatcaattgactgtaagtatttgggtttatttcttggttcactattctgttccattggtctatgtgcctatttttaaccatgctgttttggtgactatggccttatagtatagttcaaagtcaagtaatgtgatgcctccagatttgttctttttgcttagtcttgctttggctatgtgggctctttttggttccatatgaattttagaattgttttctctaattctgtgaagaatgatggtggtatttttatgggaattgcattgaatttgtagactgctttaggcagtatggtcattttcacaatattgattctactcaatatccctgaagaacacagatgcaaaatccttaagaaaatacttgctaactgaatccaacagcacatcaaaaagataatccaccatgatcaagtgggtttcataccagggatacagggatggtttcacatacacaagtcaataaatgtgatacaccacaaaaacagaattaaaaaaaaaatcacatgatcatctcaaaagatgcagacaaagcatttgacaaaatccagcattgctttatgattaaaaccctcagcaaaatcggcatataaggggcatacctcaatgtcataacagccatctatgacaaacccacagccaacataatactgcacagggaaaagttgaaagcattccctctgagaaacggaacaagacaaggatgccctctgtcaccacttctattcaacacagtactggaagtcctagccagagtaatcagacaagagagagaaataaagggcatccaaatcggtaaagaggaagtcaaactgtcgctgtttgctgatgatatgatcatatacctaggaaaccctaaagactcatccaaaaagcttcagaactgataagtgaattcaacaaagtttcaagatagaaattaacgtacacaaatcagtagctctgctatacactgacagcaacctagttgagaatcaaatcaagagctcaaccccttttacaattcctgcaaaaaataaaatacttcagaatatacctaaccaagaggtgaaagagtgtacaaggaaaactacaaaacactgctgaaagaactcttagactttctctatccctatatttggaaagaaggttggaggaggggtacagaaggacggagggaggtagagagagtgttaaagaagaaggaaaggggtaaaaaagaatgggaatagaggcatggactagaaactaattagatggtgaggcagagaccttgcattgcgtatcttacatgcactggcttggcagccttgagaactgatgtgtatattgaaagcaacagcacatgctaggtgtccagcataatacctgacatatattaagaactcaatacatgtctgttataataatatttttgagtatccagaggaactaggccagcctttgaattgataggccctttggtaattttcatacagccatgtagcaaaacttatattaaataaattgggggaatttcatattatactacattccttttgcattctcactggcaggagtatttagcctggatgaaacttgatacttcaaaaagaatcacttgctaaagggagaagtgagccccaccttctgttaggaagatgtggtgagtacatcaatattacaaagattcagtgtgttaaatcaatatgttcaaagtagtttaaatgtccaatactggtttccaacttctaacttttctctatcctctctctcggcctcttttcaaccattccttccttaatccttccacccatccctctcctaacccccaccattgtagactaatttcttttggttatctttctaagcctttgcacacttttccctattgacgagctttgctgttaggattctccagctacttctgcaaagaggttttcaaaggacttttgaaaatgcagcactgtgtatgttttggtaaaataaagcaaacattttgtgtggttgggtttgttgtttgaagtgttgcagtctccctctggggcctcctactgtcttctgactagcacctcaacagcatcccttcctgctgatttgcagagggtttgattctttttcaatagtgcataatgctgctgtcttattgcctgtttgctttagttcatatttcttctccagatggattttctatgaagatcatccctatttgtttgatctttaatttcagaccttgtcattttcttttcgagtatgcttttttatggatgtttcttttggcagaaccacttcctatgagcctcagtgtgtgttaatggcactttcatttattatcatagacaatttcaatttctagagggatagttgagttctgttgtggttcaaaggagaaataaatcctcttgcaactttggctattttatttcacttcacttttggcctcagaggacgagagagaagctgagaacattagccacatctgtccatgaagatttctccaatatcaatttgctcccacacctgatgtactgaatactcagaaaaatgctcaggctataaaaccatgtctaaggcacagacagtttaagatcaggctttgaatgaaggcctcagtttatcttacacattactgaagcccattctatagaagactaatagtttccacaggtgtcttgggtggagaagggaaaaaagtcaatggactgagatactattggtctcaggaatcatttgcccaatctaccctaggccaagctttgaaggacaggccatctgaattcactgagtgactgaatcccagcacaggaaatgttgatattcttattgattctttaatggccattttatatccaaccatccagccatccatctatgcatttatccatcatttatagtaatgtccctaaggctgctttcttgctaaaaataaggaatattgacagctgaaactcactttattattctgccacagttttaagcatccctgcaaacacgacttctttaacgatctccagtttaattccacagtatggttccctatctgcattattctctcctactctgatcatcttatttatttatttagacccagggtctcactctgacacccaggccggagtgcagtggtgcagtcttggctcactgcagccttggcctctggggctcaggtgattctcccacctcagcctcctgagtagctgggactacagttgcgcaccaccacgcccagctaatttttttgtagagatggggtttcaccatgttggatcaccctactttaaaattgtaatatagttcccttttccagcaacttccatttggtttaacctgttctttattttttctttgcacttttcacctcctagcctaatatatattgtacttatttactatgtttacagtttgtttattggctgcttcaagaacataagctcctctcaccatctactcactgtattctaagtgtgaggcatatggtgggtatttggtaagtatgtgtaaggcttcttggggaaatgacccttcagtgcctttattcaatactcaagagtgtttctcagcccctaacctggcattgtaggagacacaatgtgcgcgagtgcgcgcgagtctcatacacgggagtctcagcgtgtgtctcatacatgctgctggatgtgtggcatgcctggcccctgcccaccaattgccagtagtgaccttatcatcaatgtaacaattaaaaacaccccaggacatttccaaattcctcatatggctccagtaaggctttgcttgataattactgcaagtcttagaataaaaccatttttttacactgtgtttccacttggcaaataattagtccaccttatggcatcctaagggcactctcagagataatacactttcttttttatatgcctccctcaacagatttcaaaatcctctcacacaattaaagacagtgatatttaatggtaaaactcagctgtcaatgatgccttctatgtcagtcattaacaagccagtaaaccaatatttactaagagcttttgagcctgacttcatgccatgcagtgtccattttatagcacaaatggtaccccacccactaaggctgtgcctgtgttacctgcggtcagcatctcatctaatccttcctcacattttagcaaaaaccaggccctgcagtcaaagaacaagtttgactgatttcttttcactggactggtcagttattcaaccatgatggacaaactgctgagttaaattggaataacacaggccaagagaatcacatttaaagtcagagatggcaaaaataacagacatttctatgacagaacatcaacaaataattactgattgtctactggatacaaagtactgtggtatagggcaccagaaggtgtggttaacatgacatcaattgtcattctgctgggtgacaatgaaatatgtataggaatgtatactaatattcagataaatgcagatactgcgagcagctatgctaagtgctttacaggcacatatcacttaatcattaacatgaataccataggtatccctattttatagaagaggaagctgaagcacagggcagtaaagggacaaggtcactcagtcgggaattagtggggcaacagtttaaattcaggtttctctcatgccaaagggtcttaaccactgtgtgataaatcaaatagttttcagttgtctgaaattttcagttttcatttactttggttgtgtaggcacaaacacaagaagatctacagataatgtatattttttaacttcctttaaattaatgcatgttggattgctctctaccatttgccccatctaagtctttgtagttggaatccatcgttctctgcaaatttgacatttgatcataaattgctcatctcgagatgaattacaacacctcacattaaagaggcacttagggagacatttctattccatttcaagagacttatataagaaccctttttgatctttcctaaaattaaaatgaaaagccacattttggcaacattatggaataatacaaatgttcaattctgtggaaaaaggtagagacatgactgatcatttgatatttaaggcaaagaaatagtggttttatttgatttttcattttgaactctgtcagactgtgatccttttttctatcttcatagtttttaaaaaataatcatcagaaacaagaaacaaagagaaagcagtaaaacacattttctttgcctccaggattgaagacattttccccttggcatgtacctactaagtaggaaaacctagaatgaaagttactgtgttgcttcagtaacttctaagaaatcaatataattttggttttctgctataactctcaaagcatatttgatgtatctcttagtcattgacaactttctttatactctgaagcaaagttatcccagccaagtgtatgtggctgcggatgataaagtatggctatttgaagtttgcttcttcttaaagagaaatgcaaagttcccagaaagacgctagatacaacggttcacatacacttcacaaggcacttgcctaacttcttggaccaaattacattaaatctttgagccaagaaaattaactcaccactcattgaaaaacagtatttcagccatgtcatatctttggttaaggcagacttaacgggaaaatctctttccaatatgatatgtgattcctttacaagtacacagtttgttaagttttatacttttttaagaagtagaggttttttgtttttgtttttttaaccaatggtactctctctgtgtgtgtgtgtgtgtgtgtgtgtgtatcctaccaaattccttagttaataagcaagacaaatttattcacagaactcattttgtattatgtaaattttccaagaaaaaaaagaaaatcttaatttgtgtttcaaagcctctctagtttaagcacaatgactttgaagaaacaaccaaaaaaaagataaaatgtggatgcagaatgatgtttattttacatgtatatggtacacattgggtaccaaaagaaagtcatggttaattacaataatcactctagtttggccaaataacatggaactaacgacatgaatttcaactatggatagtaatattaagtgggttgaagtaatctctacacaattaattttttctagtgccttggcctctgaaaacttatctttggtctatatggatctatgtgcatctaattaaaggttcatatttgcaatgcagggttttagttaagggaggttaaacatgagatttccttagagcgcctcagtgttcatgggcctctatattctcatatctctgcaccagcagtaggaggatgtgagagcccagggagccctcgaacttcaaaattagatctgtgggagaaaacatgtaaatctcagccagaagaatctatgcctcctttttctcccatgctgccttactcatagcactgatagcatgcatgatctgttagccttcactatccttgcagaggaactggattcggtggtatggaaaagacatatactattccatgaatatccatgtgctctgctccatttcctgttcccttgcagataagtgagcatactctgaccagttctggccaagggactctgaatgaaaatgctaccttaaaggccaaagtatttaagagccagcacatgactctccagctctctcttattctgtctcagtgatacagaggctgcaggcccaggtgtcagaattatacaatacagaaaatagatctcttataagggagtttgtaagaaaattggccctagagagccaccagtcccttaaaagagtttatatgacagcctgggcaacatagggagaccccatatctacaaaaataaaaaaaaaattagctcgtgcctatagtcccagttacttgggaggctgaggttggagggtggcttgagctcaggaggttgaggctgtagtgagccatgatcacaccactgcactccagcctgggtgacagagaccctgtctcaaaaacaaagcaaaacaaaacaacccccccctcaaaagtttacattagtggcaaataaactttgttatgctgggaagatattaccaagaatagcttagtttactgtgacaatttaaatcaactgctaagataaccaaagtaatcagaagctataacaggacataaatgctgagtacaaatatttatttttgtacctcctctattggagaaaatctagaaaataaattcaatatatattccaaaggaaaaaggaggaaagtctaggaagtttttcatttgggataaaagccaggaataaatatatgactttcattggaacattttcaggcactcagagattcagagatatccttaatgctaagtagatgtataattagctccctgtttagggactccaaaatgtgccatgtcaaaactgtctcctgaaaatgttgctttgcgattccaaaagcaatcagaggttgttgaaaaatctttgggattttgcagtgtgcagttttccccaacaggcctaacattaatcattataggaaaaacattcaaactcccccattctttcatagtctagtctaaacattcaatgcaatatcataattctgcagacataaattccctcattatctgtgggccaggtcaaccacagcacagccagccacctagcagacccatgagcagggccttttgcaaaggtgtagcactggccctcaaaaagacttacagttaagcactccaggaggctgcaattgtgcacagcagccaacctgtctaattgggtcattttttcactgggtgatttatatagaatgtggactcaaggctgactgctcttcgaacagtatgactgcttttgtctgactgtaccaatgaagcaggatggggttgctggtatttaagaccaggcattctggtcccaaagaaacattgctttgggctgtagttctgtgttattgcaagaagcatagtatccgatgttaccagtgtgggctcagttacttcatctgtaaaatgggaggctataaccccacctacctcttagggttctcgtgaagatgtgcttgagaagagctgaaacagtgtgcctgacacagagaaagcattcaatgaatgtgaaccatttatgctatacagcattattactgatatgaagtattagtgatacattattgatataattatcatcaacattatctgtgatgctggtgatatgatgatgatgatgatgatgatgacagtaataatcattttctgagtgcttgccatgtgcttgccagtctactaagtgcctaatgtggattacttagtgaatcctcagggcaactattgagactattatctccttttgatgaatgaagacactgagtcttagaaaggttaagaagcttgatcaaagaagtaataaagctgaaatagaagccaagcagtttgacttccgagcctgtgcccttagttactaccctctaccccagcattgacacaaacacaaccacagcttttattagttgtccttataatgacttagcctcatgcgataagactgtctgtcccagatagagccacaagttacttaacatatctcagtgtcagcagccacaacctgctaggtaactacaactccaaagtgccctgcctcctgaatgagatggaaaatcagtggaatagggaatgggggttctgcttggaaataacctgtaaccagaccagttaaggtggaaaggggtggctgtgaaaaatgaaaacaataaaacaaaacaaaatgccaaaaagcagggtgatatagagagggtttaaagggtattgctcccctttcactcctagcctgggattcaatttgtggccaaaagctgatggtaagtgtgtgtgtattgcagccatagtcagcagagcaaatggggactctcaactactggtcctacttcccctaaggagctgggtagttaacatgttatccctgcacctgagtaaattaacccattactccttacccagtgatccacttgcccccccatgatgtgcactgtagggagttcatgctgtttagctcagaaattctaagttcacatggagtccagttttcctggattgtaccttaagtggttgattgttggagccacttcatatctatatttaagttagactattgagtactgtccctcagtttcaggagccatgggagcaaatcgaggggcaaaagttacttctggatcttcccaatcatttctcaaccattgagtcacagcctgtgacaccagacgtctttaacttaactccaacctcattgtgctaggttctgttttctcctcaattatttttttttcttgctctaagaaaaggataatacacccctaccttatctgtaacatccagccacattgtctggcttggttatgtgactttctttgcccaaaggactataagcagataagaaatatccatgtctacatagaatctttaaatgaggttgcaaggcttaactttctgcatttttgtcctctgcattgtgaatagcatggccccgatgagggcttctctgcttcagcctaggtcttggaataagagatgcacagaatagagccaagaagaagtgctgccaaccacagactcataaatgagaaataaatatttgtttatttgggggttgtttgttactgcagccgaggctaatacacaaatttttcaataagaactcagcctcagcttacatcatgtgcgcaagtgaatctggggatgctaggggctatcttccctatcattgagtgaaagactatttatgtattaagccaacaggcaaggacagaatcaagaaatgttgtaaaagtaagagctccgagtcctttgagcccctgaatccagctgtgcctgaagacttaatgctacatgttatgattatgtgagccaagacatttcttttactttagctagtttggattaggtttctaatctggtttaaatgaatactgacttatatcaggtctcctcactcttttgcaatgatatctgagcacaagcatatatgacatattaagtaatagtaatcacatgggggtaagttacactggggtataaatcattgtaattgaataagcctgtcatgggttgaactgggttccttctccacccccagcttcaaatggatatgttgaagtcctaatcactactacctcaatatgtgacattatttggaaatggcattgaggatgcaattagttcagatgaggccatactgaaatagggtgggctcctaaacttatataattgatgtgcttataagaagacagccacatgaagtttgagatacacataatgtcttgtgaccatgaagacagagattggagtgatgcagctacaagccaaggaacatcaaagatcgctggcaaactaccagaagctataaaccaaaggcaaggaaggattcctctacaggctacagagagagcatgaccctaccaacaccacaacttcagacttctagtctccagaactatgaaacaataaatttctaattttttaagacacctagtttgtaatattttgttatggtggccctaggaaactaatacaaagcccatcaggtgaatttttaccaacagatcccatggaaaacttctgatggaaatcactattatactcatgaaggtcattgacagggtttggctctgtgtccccacccaatctcatctcgaattgtaatctccacatgttgagggagagacctggtgggaggtgattggatcagggggacagtttcctccatgctgttcttgtgatagtgagttctcaagagatctgatggcttaagtgtatggcacttcccactttgtgctctctctcctgccaccttgtgaagaaggtgcctgcatctcctttgccttccaccatgactataagtttcctgaggcctccccagccatgaggaatggtgagtccactaaacctctttacttataaactattccagtctcacataattctttatagcagtgtgaaaatgaactaatacagctatattgccatatctatgtccacacaatatccagagacacagaaaggaaaaaggaggcagcacaatgcaatggtcatgcacattggctgaaagatcaggaagacctgaattcaagtcctagtttgttcatttactttaggtgatttctgactccagtgttctcctgtacatcacagaaaaatccattgtttcattcatgatgttttatgagagttaaacgaggtagtggatgggaggtgctttacactgtgcctggcagagtatatttgttaaacaatagatagatagattagctaaatagacagacagacagataggtaacttagacatatagatagatgatagagagagagagacagagagacagacagacactttgggcgactatcaaaatattataaactggttggcttataaaaaacaaacatttacttctcacacttctggaggctagaaatccaagatcagagtgctagtatggtcagttcctggtgagaaccctcttccaggttgtagattgtcaactttttactgtatcctcacgtggtggaaaaagaggaagttagctctctgacatcttcttataagggcactaatcccattcctgaggggccctatcctcatggcttaatcacttatcaaaggtcccaccttcaaacaccatcacaatggagattatatttcaacatatgaattttgaaggacacaaacattcagtctataacagatagacagatatacacacataaaaatatatcaatgcataagtctatagatatgaaggtctgtatctttcctgcctatataaaatttaatcaaatcattagcagttaaatagtgaattttcaacacattcccaaatagttttaacttacttaatatgttgtgttggtggtaattttcttgttgttgttttttaaactgaacttgattgacctgattttatgtagatatgcaaagataccacttactcatgcagaccttgttgtgtaaataacccaatcttctgtctttgcaaagacaatctttccctaagagttataatctcctctcaacacatcgattatatggatcaaaggccctctgacttatatcagcctgggccaaaatagtcattaccaaagattttccactttccctctttaatagactaagctttagaatttgggtaatggtttggatgtcaaacaaaacctgagaacttgtttaggttcagaagaaagtgagagtgataatattcctttcttcatcaatggagctttctaccctttcccgcctattatgtctaatgttattgtgcaccaaaaatgaagctctcctaatcttcatttaccttcataataaagagagtctttgtgcgaaccatttctactatactgcaaagacacaaagaagaaggcctttatgctgaagctacaatttgttgacatttttatggatatgaacctgaattgtcatgagtgagcttgttctaggagtagatgtgtccgagttttcacacatgaaagactgggtcctgacctaccaagaggcagtaaatggaatactctgaggattaaagacattactctcaatatgtcttccccataagcctaagattccaatttagtgctacgagaatcacccctctgtattacaatatgcattgagaagactctctttgaggtgtgttagaaagaaataccaacacacttgaagaccactagctcattaagttgattagttccttgccagcctataatgaaattctaagatctggagggaattgaatactggatgattaagttttggccaagcggtacattactaaagaaatagggaggagaaaagggggagccctagtcgcttaagagtaaatcaaggggacacaaataatctaggaggggatggttcccaaatggccccaggaagtcctgttgggatgggcacccagatttttaaccattttccctcactccccatagtaccttaaatcaagaatatccatgaatgttactaaatgcagcatgcccaagatggagtcctccccatgagtttacaaagaagactcaagtcaagaagacttgatggactaggaggtactacttaaatgggaaggaaaaagtttcttgctagatgctgcaggagactagaagatgagtagatattctgtgatcctctcaaaatttcacaggttgagctcctttgcacgattccatactgttaggctgggcattcttatcctttgtgactgctgcacaaggaagaaaatgagccacactatcccttcaaacgctgagagctggtttgacacatttgtgctggtttggataactaagtaggagacccaggacataagtggcagctggctggcaaggatgtcagatgcagaagtacccagaaaacctactcagggtgttttcttcctttcctggtcccctcctgttacaggaaggctgacctctgcacatgccatatgagcttggccctgcggtttgccttctgccaaagaagtccctgatataaaatggaacttcagaaccttgcctttttaggagtgtcattagaaatcaaatcagtatgggctgaacaggctcaaggactgctgctttagtgtggcagctgaagtccaaatttttgagagtaattgggcccaggctgttaacaggtgcagccacttcctactagggagaaagaatgcctgccatgtgtgttacacatggcctcagaaggaagccacctgtcaagagaaatgcagacactgggctggaggggcccgaacagtgatgcaagtctgagtgatgactaaatgaggcccctgcaaaggcagaatggcccaggattgtaattaagacactttcttaccttcgcatggtaagatttgacttgttatagtgctatttctagtcctaaactcactatacgtctatgctatcatttctaaattatattccattcaacactagtatttggagaaacacagttaattttctgtgagaaaaaaaagagttcagttttttggatttgcttaggagacacttctttgtacaggctccatctggcaattctcagaacacattattctattatctaaaaatggctgagtagtcctggagtatagaagcctgattaattttaagtcacctttccctgaaccaatacagtcatcccttggtatctatgggaaattggttccaggacctccctcagatgccaaaatgcacggatgttcaggtcgctgatataaaatgtcatagtatttgcatataacctatgcacatcttcacatatcgttcaaatcatttctagattatgtataatacctaatacaatataaatgctacgtaaatagttatactttattgtttagggaataatgacaaggaaagaaaagcctgcacttgttcagtacaaacacaattccccccaccccccaaatatttccaatcctccattgattgaacccatggatatggagggccaactgtaaacattttcattagatcttttataaaaatgtcccatggaatcctatttgagaaattcaggattacacaagtaaacaaaagttgagagaactggttttctctatcaaattgggcaaaggtcttctctgcccttgtcattatgtggatacgtttttctatgaggagcactatagcacagtggtgaagggaatgggtttggacttggactgcttgggttggaatactgcctccagcatccattacctataggactctgggcaagttacaaaacctctctgcactgttttctgcaatgtaaaatggtggtggtgtgggggggtggtgtgggaataatagtaatatctgccccagaaggttgtggacagatgaagtcagacagcctttgtaaagagcctagaacagtgcctagtaccctgtaagcctggggcaaatgttagctgcagtcattgccaccatcaccatcatcttgccatcatctcccatcctctctctcagaatcagattccagaagtcattttgtctccattttcctcactgctctccacagtcattcactctcgctgtcccactcctgcttttgaaaagcctccacccctctagccttcataactagcacaggccttcctcgctccaggctgaaatattacagctttcccctagctaggttccctgaccccagtcccactctctacccaaacaacctgccctcaatgcccagacaaacctgcctgaaaccctgctgtgttcttggccccattctgctacaatgtttctgccttcattgtctagatggcagagttcaaggttaccttgggttgcaaccctctcacaaactaattcaaacctgttttccaaaccacatttattccctcacccccagctactgttcctgctgttcttcccacttggaatgtcgttcctagcctctgcatagactcaaattccaagtagattccagaacccatctcagcttgtgtcttcttcccaaggccttcctgatccctccatctcttactctggcatgggacactagcatctgctctactgtggagtggcaggtttagagggcttaggtttagagacctgggctcatatgccagctccaaaatgagcaagcggtgagagttttgatccagttgtgtaacccctctgtgtctcaggttccttatctgagactggagattgataatgctctctctccaaagggatagcatgaaactcaagcaaaagtacttgtacacattcagatttttttccagtcttcctgtgtgttttttgaggagccctagatttggcaaaggtgcctttgaaggcggaagtaggaaactgaagcgggctaggttgtcagacctccagcccctgcctctacacttcaaccagagctgcgctaccttgatcaattatatttatatatttgggatctgggtgacctttacttaggaaaaaaaagagatctattccacaaaagaaagaataagaaaaccatctcatctcccagctgggcgcggtagctcatgtccccaatcccagcattttgggaggccgaggcaggtggatcacttgaggtcaggaatttgagaccagcctggccaacatggtgaaaccccatctctactaaaaatgcaaaaaaatagcagggcgtggtggtacatgcctgtaatcccacctactcaggaggctgagacaggaaaatcgcttgaacccgggatgcagaggttgcagtgagctgagatcatgccattgcactccaacatgggcaacagagcgagacttcattttcaaaaaaaaaaaaacaaaaagaaaagaaaaaagaaaaccacctcttatcattagtaccatacaggctttccataattatttcactatttcacaacagtacagctggtctccccagatacattgtaacctccttgggagaaaggactgagtcatctttaagtatgtattttccctagttaaatatgttgtacccggtaagtacttaaatacttgttgatgaagcagctctgccttactgcccaccggttcctccagagatcacacttttataaggttaagcccatcaagaagttccttttccacttccctgagcaggcagccatggcttctttatctcctttcactctcttctgggaagatctacttcaatcccagtgccattatctctctctaccaaacactgctcagagaatagcctctgagacctgtttccttaccaggattcagaggatcacagatactagagatgaaggagaaaaaaaataaatctatcagggcatcatgtcctctccttgtgcaaaacggttaagtcctgaacattttctaaatatttgtcaggcctggtattaaaggcttgaagtgacaaggtccctcaagggagaagttggcattaaacctcactcttaaagatgacttcttttactgacttttcagtttcatgtttcaccactgaatctcacttctcacttttagttaaatcccttctaagtagccaggctacagtgagtgggggctacagaaaagccacaggaggagtcagaagagggtagagctgtcactctgtgggctatgtttccctctgactacaggtaatcaaaaaggatgggcaaggtgaaatcttgacatctcacttgaacagaagtactcccccattcttgcagattccccatcattcccattcagagagccaaaatgcaactgtgtaattataagataatgtcttatttttgtggccccactgaggttaccaactcagacacctataggggccctttgataaggatggcaaacccacttccttcagcatattgccagctcacaggaaggtgcatcatgtcaccagattatccccctttaaaaaaaaaaaaaaaagaaagaaaccatctatcaaaatttcaatgaggaatctcttcatttttgaatgttggcaatgaattcaaattatctttaacccattgtaaaggcacagctgacaccagtcccttctgtaggagatttcttctccttctgaaatccatcgccaattcataagcaagcacgcaggaatggacaatgctgtatgtttattacatttataattttgtgtgtagaagccttgcctcaatcctcaaaatgcagacacctatgctgcagtcttttgcgtggttacatcactcaacgtccccagtacatatgttcagaaaaatggtcaggtcctcagggaatagttaaaactgtgcaggactagactacttaggtttatatccctgcctcagtgcttgacagctctgggaccttgggcacctcagttttctcatctatataatggtgatgataataacagccctgggctcatagggttgttgtgaggtttaaatgacatagcagggtgtacatcatttagcaaatacactaggagcttaataaatgtcatttggaagctgcttcacatttccacattctattaaaacacccaggaaccaatggtgccctcacttcatctctagattttgctaaagagttggtttaattttcgccatgtcttcgggtttcatttttacctctgaaggtcaagttggcttgctacattcttggcagagtccatagcccctttgatggtagaaaatgatataaatgaaaaggtcagatgatcttgcctgggttacctgtcattctggaagatcacagctgtatgctaaactagatctaggtatgtgtgtggggtggggctgaagtctacacccatattgtggtaggcacagatatgtaccacccaggttgcccttcaaggagggacttggcctcccaactgtaaggtggatagtgattagcaagcactgttcagccattagctacttgagaatgggcctcagctccagtgagctgcttccctaaagaccatacatttcttgggcagctttcatttcctacagagtgaggcaggtgtgacaagatgctgctgtttccattcatcacggaacaatccagataggcaataatgaacccagggctccccactggcttgggtgaagctttggagggcctacctcaaagtccagcttctaccttgcccactcctgtttctgccccttcctttcacaggtgttgatgcctaataaacatcttgtactccagagtccatctcagcactgcagcccaagaacccaacccatgacacacgggtgtactgatgcacacacacactcctgaaacccagacaatcctttaaaactatctttttaataaacagaaaccagccaagtttgattataaagaaaaccaatcgtgcattgagacctatgggattagcagggtcaggggtatctatagagttgggaaggattaccactgatattttcttccaatttcttttattgtggtagaatacacataatctaaaatttactatcttggctatttttaggtgtacagtccagtgacaataagtacatttacattgtgggctacaattgccaccaaccatgtgcagaactctttttcgtcttgtaaaactgaaattctatacccattaaataacaactccccattctccctccccccagcttctggcaactaccattctactttctgtccatgagggttgacaaatctagataactcatgtaagtggaatcatacagtatttgtcttttagtgactggcttattgcacttagcacaatgtcctccagattcatccatatcatagcacttatcaggatttcccctttttcaaggttgaataatattttattgcatgtatataacacatttgatttattcaatcatgtttcaatggatactgagttgcttctacttcttggctattatgaataatggtgctatgaatgtgggtgaacatgggcgtacaaacatctgttccagttcctgctttcaattatttcaggtgtatgcccagaagtgggattgctggatcatatggtaatcctgtttttaattttgtgagaaactgccacactgttttccacagcagctgtaccattttacactcccaccaacagtgcacatgagttccaatttctccatatctttgccaacacttcactcttttttgatagcagccaacttaatgggtatgcagtgatatctcattgtaatttcatttgcatttctctagtgattagtgatgctgagcatcttttcaactgtttattggacacttgtacatcttctctggagaagtgtctattctagtcctttgcgcatttttgaatcagtgatttttgttgttgttgctgagttttaggaattatctatatattatgaatattaatctattatcagatatatgatttgcaaatattttttctcactctgtgggttgcctttttactatactgatggtgtcttttgatgtacaaaaatgtttttcatttaagtccaattcatctatttttccttttgatgcccgtgtctctggtgtcatatccgataaataattgccaaataaaatatcatgaggcttttgctctaaattttattctaagagttttatagttttagttcttaaagttaggtcggagactcattttaaatttttatatggtgtaaggtaaggaatgtacctaacattaattgtattcttttgcacttggatacagagttttcctagcggcatttattggaaagactgtcttttcctccatttaatcatcttggcactcttgtcaaaaatcatttgaccacatatgtgaaggtttacttttggactcctctatcctctattctattccattgatgtataaatctatctttatgccaataccacattgctttgactcctacagtttacagtaagttttgtaatcataaagtatgagtcctccaggtttgttcttttccaggatttctttggccatctagggtcctttcaattacatatgaatttcaggatggctttttgtatgtcagcaaaaaaagcatcgttggaattgtcacagggattgtgttaagtctatagatcgctttgtatagtattgaaaacaatattaaatcttctaatccataaacataagatgtgttttcattgattgataccttctttcagaaatgttttacagttttcactgtacaagtttttcacttctttggttaagctaattcctaagtattttattctttttaattctcaattttcttttcagattgttgttagtggataaaaatgcaatgtatttttgtttgttgactttgtgtcttattgctttgttgaattcatttattactccttacagatttttttttttggtggaatctttagggttttctacatgtaagttcatatcatctgtaatacagtttgtatgttgtccccttcaaatctgatgttgaaatgcaatccccaatgttggagatgagtcctagtgggaggtgactgggtcatggaagcagaactctaatggcttggtgctgtcctcatgataatgagtgtgttctcatgagatctgtttgtttaaaagtgtgtggaacctcccacaccctccttctcttttgcttccgctctggccatgtgacatgcctgctcatgcttcactgtctgccatgagtaaaagctctctgacacctccccagaagccaaacagatattggcaccatgcttgtgtgactttcagaactgtgaaccaattaaacctcatttctttataaattactctgtctcaggtattcttttatagcaatggaagaatagcctaatacaatctgcaaacagatataatttaatttcttcattttcaatttggatgcctttatttttctggttgaatttttctggctaggactttaagtactatgttgaatacaagtggtgaaaatgggcatactttccttgttcttgatcatagaggcaaatctttcagtctttcgtcactgaacatgatgttcaatgtgggttttttatatgtggctcttatcatgttggggtagtttcttacttttcctagtttgttgagtgtgtgtgtctgtgtgtgtctgtgtgtgtgtgtttaaaccacaaagggcttgaaatgtggcagatgctctttctgcatcaactgagatgataatgtgtttcttcctcttcttgctctgctgtgatgtattgtattggttgatttttgtgtatagaaccatccatacactccaagaataaatctcgcttggtcatgatgtataattcttttaatataccggtgagtttggtttgctagtatttcgttgaagatttttgtagcaatgtttataagggatattggtctgtagtttttttgcaatgtctttgtatcaaggtaatgctggcttcatagaatgaggaagtgttcccttttatttaatttttttgaaaagtttgaaaaagatcggtttagttgtttaaatttttggtactattcaccagcaaagtcataaggtctggggcttccctttgctaggagattactgatcactgatttaatctccttactagttttaggtctattcagtgttcatgacttagtctcataggttttgtgtttctaggaatttgtccatttcacctgaactatccaatgtgctggcatgcaattgtttatattacttgcttataatccattttatttctgtagacttgatagcaatgtcctcactttcatttctgattttattaattttagacttctggttttttttcttagtctagctaaaattttgtcaattttgttgataatttcaaaaatcactttttcccctgattttctagtttttccttgatttctattatttttctgttctccatctcatttatctttgctctaatctttattctttccttctgttagctttggggttagtgcgttatttttctagtttctaagttgtaagcttagacatttgtcttatttttaaatataagtatttgtagctataaaatttccccttagtactgttttcattacttccatatgtttggatatgttgtgtttttgttttcatttgtcttttaagtattatctaattccccttgtgttttcttatttaatccagttgttgcttaagattgtgttattcaattttcacaaatttttgaatttttcagttttccttctgttactgatttctaatgccatcctattgtgatcagagaagacactctgtacaatgtctgtcttttaaaatttactgagacttcatttgtggccttgcatatggtctatcctggaaaatgtctcacgtgtacttgagaagaatgtgtatgctgttgttaggtagagtgtttggcatgtatctgttagatccagctggtttactgttttgttcaagtcctctgttttcttacttaacttctgtcttttgtctctttgctagcattttttatttaaagtctattttttctgatattagtatagccaactctgctctgttttggtttactatttacatggaatatccttttctgtccttttacttttaacctatttgcatcactggttctaaagtaagtctgtgaagacagtatatagttggattatgattttttaaaaccattttgtcaacctctgtctattgactaggctgtttaatccatttacatttaaagtaattactgttaaggagaggtttgattctgtcattttgtgacttgttttctatatgccttataggtttattttgtccctcatttcctgtattcctgtcttcttttgtgtttggttgatttcttgttttgataatgaaatgattaaattccttttcgattttttctgtatattctttagctgttgtctttgtggttaccatggaaattatatttaacatcctgaagttattacactgtaatttgaatttatgccagcttaacttctataacatataaaaactgtgctactttaacaacattataccctcccctttctgttgttgatgtcataaaattacatctatatatcttgacttcctcaaaacatcaactaataatttttatccattagtctcttaaattatatagaaaacaaaacatggagttataaaccaaagttataataatattgatttttagaccaatatattttaaaaatccgttattctcttaattcatatagaaacaaaaagtggaattacataccatgttaaaataacactagcttttctacttacaaatatatttaccaatacaaagacctttatttctttatatagcttcaagttactgtctagcatcacctcattttaaccttctggactccctttagcatttcttgaagggcagatctagttctaataaattttctcaggttttatctgggaatgccttaatttcttcttcactcctttacttcttttgcagtacagttttgttggatacgtgattattggctgacagttttttttcttttaccactttgaatatctgagccttctggcctgtaaagcttctaatgaaaaaatctgctgataatcttagtgaggatccctagtgcatgacaaatctcttctcttctgctgctttcaaaattctctctttgtctctgactttcaatagtagtatttataatgtgttttggtgtgagtctttcaggctcaccctatttgtattttggtgagctttttgatgttcatattcatgtcattcaacaaatttgggaagtttttattcattatttcttcaaataatctctctgcccctttctgtctccctcttttccttctggggctctcacaatgcatacgttggttcacttgatggtgtaccacaggtcccttaggctctgttcatctttcttcaactttttttttctctctgttcctcagacttaattttcattgacctatctttaaattcattaattctttcttctgcctgtcaaaatctgcctttgagttctagtgaatttctcatgtcagtcattatatttttcagctttacaatttatttttggtttctttgcatcactctctctttattgatgttgcccttttgatcagacattattttcttgactttccccaattattcctttagtttttttgatcatctctatgataggtagtttaagtatctggctaatggatccatcattaggtcttttcagctcagtgtccattggtttatttatttattttccctttaatgcttaatacgttcctgttgctctatatgccttgtaattttatttttgttgaaaactggacatatgaatcgaataatatgataattcttgaaatcagattctccccctttgctagggttgctggtatttgttttcatgtttttgattgttgtaggccaactctatagcaaggatcactctgaggtataaacttaaagtcttttctgagccagtgccttgcctggaacatgcacagtagctatctaaagtctcccacatatgtagttgcttttgaatgtcctagttttcaatatctgggtcccaaaaagggaaagaagaaaaattaagggaagcgaaaaaaggcatcagccctttaaattccctaggagtcacttcagctagagaggaaggtacaacaataatggctaccacctcttttttgtacctctgtgattgaaaacggcaatcagtaatcagaatacagatcccaatatttgcaggatagagtcctttttgcccaccgtggctcccacaagccatgtgcaaaccaggagtacatgcacagctgcctgccatggggctgaaagatggggaatgggtagttattactgtgctaagaactgaaattgattgaaattaatcacaatttgtgcccctttccctggaatattcaggccttcagtggactccagagttccaaaatagctacaacagacagattctgccaatgcaattgttatctatgtggaaatacagatttctcaagcttcatactctataatcttcccatcaattatattttaatatacctatgtttatagggaaagaatgccaaaaagatttaaaaaaatcacagacctttaatagctctttggggatttttgagcaatttcagtaatcttctaaaataatatttagaatatcttctaaaataatagagatcttagaaattataaagacaaaaaagattatttgtgttgacattcaatactttttcttctgaaattcccaaagtacttacatttaggatatattagataaattaggtaacgcaatgggaaggtaagctattctaagttttccagccttgttattatccagtaataatgccattcaacttgctggcacttagattgtctgaggaacctttccaaatatggtgtcatataaatgccattgtaaagctctaccagaatagcattatcagattcttccttcaatgcccagtaacaataaaacacttggggaaaaagatctcatttcagagtccctgtctctcatccttcactcttgagtattcagctgcatctgtcattctttgtttttatatttctgtttattcaaatatcacatgatcctaaaacagaataaatcctgtcatcatgcaaattccatttaggacagtactctcatatatgaggtcaggttcatatccctttataggcaatcaagctaatgtatatagttgtttgttaagaaataagattctcggccaggctcagtggctcatgcctgtaatctcagcactttgggaggccaaggcaggcagatcacttgaggccaggagtttgagaccagcctggccaacatggtgaaagcccatggctccattaaaaatacaaaaattagacaggtgttgtggtgcacgtctgtaatcccagctactcaggaggctgaggcatgagaatcacttgagcctggcaggtggaggttgcagtgagctgagatcatgctactgcgctccagcctgggtgacagaatgagactctgtcacagaaaaaaaaaagatgagattctcccattattaaatgcatatgaaaaagatcaaataatgcatgcgatatgagttgtgtccaaaccacaatctcatggaggcaaaattatcaagacttcaatccgattggtggcttgcaaactaccctaggcctccaacccacaaatatatacagcctccaacccacaaatataaacagacacagatgaaatctggatgctaggaattcgtttcctaaactttccaacagcacgtacctgagggactgtatggaagagatgaaacaagagacatgtttaggaggaaggagctagttgtttaccaattaatgacgaactatctaaaacttctttgctctctaaaagtaagacttgtaatgttttcagaaataaatatgggttattcttaatcaggtatattataagagtagcttatagaaggagatatgcattgtttctgcagtgaaggaaaaagcataatttaatttttgacaaaatcagaaatattataaggtatatgttcagctgcagaagctataatacctttgactttagttctttaaaataaattatagatacacaactatatgcactaacagcctaaaagtaagtcatgctgggtttttttccatacaattttaattaggtatattttttccaatgtgttttgaaatgatctgctaggaccaaatgctaacatgaaattccctgcatgctggtagttaatttaataaaaattagaaaggtgaagccctgttccctagagggagaaggtcttaacacaaaacattcattatttccacataaattgcaaaaagtaaagatgctggatttaaaatctaagcaggaagaaactgtcaactttcattatcagtggacaaatgttttaatttgcaatattccctagcaactttttgaacagacaactttacctctttaccaacatctactttaattcctaatttgcagctgcataagtactatgttgggcccaaagctttgggtatatctcttagaggtaatggaatccttgttgttttctggcactgcctcattaaaatgaaactcagactcagggtaaccctgaaaaacctaagccctccaataaaaaatgtggtatatccctgcacttaaattacgcaggagaagtgaaggctggtacatcacacacagaagagaagctaaaggtcaagctattagagttaatgagccgatacaagctcaggctctctaaccagagaggttagggacagaatacatggccaccccaaggaactttatttaagatatcaattaaaaatgagtcacctctcttctcagctcctgcactcaacactgacactgggaacaatgactgaaggactcacacatgtctgagaaaaggcaccttgtgggtgtgacttgccacaaaagcaagagtctttctgcatttgtaaatgtgttggtaaggcaacaaaaagaatactactgtgcaaggggaggtagaggtggtgatcctggcaacctaaaagcctgattgtatgttctaatccattctgatgtcaccaaagctccccttcgagggaataacctggattatggccaatactttctacttctaatagtcttccagtttcattgttcacaaggggttggtaaacaaaaatcaatgaaaagagcagggtcttctctattttggatttggacactgatgatgaagctgtgatattctgatccaggactcaatggctcctcctggatcttctaacaaggtcaatctggctgagttccagacagtcagctgatggtctcatatgaggaatctaaagttgatgaagatggtggtagtagagtggtgtaatcctcatagctcaaaaacgatcagagctcattaattattaactaactagaacttttatggctcattagctactggttaaatgtcaggtaaaatgtaatatttaatagaaaatgttaagattagaaatatgcagagcatttcttatgtgccagacctatgctaagtatttcatatccattattgtacttgatccttacaactcccatgcaagggacctatgtttatctcaatttaacagagaagaaggcaaagtgtgaaaaactaagtaacttgtcttaagttaaacagctaatggagtggtagacttgagcttcaaacccaggtttagccaactccaagcccattcaattatcacttgatacacacccaacctatgtaatacttagctttgttcttagtcattgttgcaaagctcatttcacccctcagtcaggcttattacattcattcgtgttctcaagagacaagagggtcttgcccaaaactacagaatatcactatcacaagttgccattcccactagaatttaccttgatccccagtgatgctacatgcattattatgttagtttcttcttggaggtgttatttttaaactgcaagattaaagctcctacaagcttctgacaacatgaaaatcagacacgactttgcagtctttttaaaacaaactagtaagaaggtcccaattaagagaaaaagagtagtcacacatacctgtagaactgattgtaatttaccctttcatcttgctctaaaacacattccttgagtctcagtttagtagagataagattcacccagtcgggggatattagttcttcctggatattttaattaaactgttacattgagtagttctgaaaatcacatataatcattcaaggtatggtggagttctgttctccagcatatggctctccacccagccacattccatctccttaggtaaactagctggaggccttcagtgtaagctctttaatttttaaactcttgggtggtgctttgttcttcgggtagagagtagagcaagagaacgaattaccaaacagtaatattacccccatcgacaagcgggtggtgtttatatcacacatactatataccaagaaatgcgccacaccttttacatgaatactcattttaaaacagtaaagactttatatttagagaagttttaggtttacagcaaaactgatagtaaggtacggagatagcccacatatcccctgccccacatatgttgcctcccatattaacttccccccaccagactggtacatttgttacaatttgtgaacctacaaggacatatcacccaaagtccatagtttacaagaggattcagtcttggtgttgtacattctatgggtttgggtaaatgtataatggcatgtatccaccattacagtatcatatagagtagtttcattgtcctaaaagatcctctgtgatccgcctattcatccctccctccctcctaatccttggcaaccactgatctttttattatctccataattttgccttttccagaattccatatagtcagaatcatggagcatgcagcctctttaggtaggcttctttcacttagtaatatacatttaagtttccgccatgtctcttcatggattgatagctaatttgtttttggcactgaatcagaaacccttgttgggatgtaccacagtgtatttatccattcacccactgaagaatttcttggtggcttccatgttttggcaattaaggataagactgctatgaacattcatgtgtagatttttgtgtggctatgttttcaactcctttgagtaaatatcaaggaatacaactgctggatcatgttgtaagagcatgtagttttgtaagaaatcgccaaactgtattccaaagaggctgtaatatgttgcattcccaacagaaatgaatgagagttcctgttgcttcacatcctctctagcatttggcattgtcagtgttctgatttgggctcttctaataagtgtgtggtggtatctcactgtttgaacactcatttttgaaatatccacataggctattatgatcttcattttacagttcaagaagctgaaactcaaagaatgtagatatttcaaactggccattgtaagctagagccaagattcaaactcaagtttggtgaatttcatagcctatactttctatcattgaggtacatcttgttttctcagttgtattatgtgatttgcaagtcctatgaataatatatttaaattataccaacatgaaaactaagtgtaatcttcagtcaataaaatatccactaaatacttcaaaatatgaaactggaagcttatctaaatgaactaattctttaatatcaccatgaaaggatgatgttttaaattaagaagtgaagaatttatagtttccagattgagaataatttccacaaatttttattttcatcatattctattgtgggtgtgcatgtgtgtgtgtgacagacacatatgcagacacagagatatggggacacacacatagacactttccatctcatgccatgttggaacttcccagagacagttaaaattagctagctaatttccataaactatcaaaataaaattatacttattgagagtctagagttcctgtcatgaagacttagcagttaaaaagcatggaagtcatggaatctcagtgctccttcgttgcaatccacactcctgctacaattagaatcccaccaatagataaagtcatcaggagctaattagtccacgtgtaaaaaataaaaataagacaaagaacagacttctaaaaaaaacaaaaacaaacaaaaaacaacaacaaatcatttgaaccattgggtacttcgagtacatgaaaattgtgaagtaaattaattagctttgcattgattggtatcaaaagtcgttagccctgcactgcaaggaaatccccagaagcctaaggtgcatgaaagaaaaaggctgggaaggaaatcaatctctgctcttcaacgctgatgctttaaagggtccctgctgtataactcgcccggaagcattccagggggaagaacccacagatttatatctgccacacgtgtcactgaacacaaatacgtctgataaataattgaagctcggtattgtgcttacgtcgcatgtgcaaaaaaacagggacaggaaggcaaagaggtcaagtttcccatctgactttccaatgagcatcccaatcatcacttaggtcattattctacctcgtgaagtgtcagaactcattgtcttagggaatccaggtgctggcatcacatatttagcaaatctcatttccctctctctcacaccgcagagcactctctagtccaagcacagtgcagggcagaatccagagcttattttatttaatcctcacaattttgtgatttttacagatgaaaaaactgaggtctggggaatagaattgtttttcacaggcacaaagctggtaattggtagatctgggatttgaaccgaggtccaggaaactctagagcccatattattgccatactaggctccctctctaaataactttctcattaagtgagcagagagagaggagccagactgccctgaggcctttggtattaataggaggctaagaagctcatgcagctaagtctctttatccaacggcacatccctggaaggagaaaatgggctctgttggaatccttccactgacaggaagctctctacctcacataactacagacctgattactaaaaagactttggtttgcctttccaaaactcatatccagtgatcacaattgtggcctctgaagcagtttgattcaatactaattgcactcagtacttggatctatcataactgtaacattaaacaatgttttcccctcgcagggttcttttgaggatacagtgagtattaaaatgggctggtacatagtaagaatttgcccaatgttaattataaaaattttcctgatattacttggtaagttattctgttaaatggaataaacacccatgaatgccacatataaaccaacagctttgaccctcataatgacccccatctatccatgttgtcctcccccatttatcttcttgtctccaaggtcattatgttcctgagtgccaggttcatctttcttcttacagggttttattgcatgtataattggtcctaacatgctttataatctaagctgttttaaattttataaaaaggattccatccttatttaatcttatgctatcctcacaaacttattttcccccacttgatattttactatgaagaaattaaaagttacctacaactgaataataatgaaatgctacatattaaaatctgtacttataatagaagatagcctcaatgttaataaggtgtcaatcttaagtatacaaaaactgaacaaaataagttcatatttagcaaaagaaaaaccacaataaatatgagcacaaattgatgaaatagaaaaatattttctagaaaagatcaaaaaagtcaaaagtagattctttgataaaataattaatagataaacctttttttgttttttttttttgagacggagtcttgccctgtcgctcagtctggagtgcagtggcactaacttggctcactgcaagctctgcctcccgggttcatgccattttcctgcctcagcctcccaagtagctgggactacaggcgcccgccaccacgcccggctaatttttttgtatttttagtagagacgtggtttcactgtgttagccaagatggtcttgatctcctgacttcgtgatccacccgcctcggcctcccaaagtgctgggattacaggtgtgagccaccacgcccagccaatagataaacctttgacaatatcgattaaaagaggaagatgttttgaatgaaaaagtgaatatttattacaactaaaataataaatggctattgtcaacaactatctgtcaaaatttttaaaaatttagatgaaatgtataaatgcctaaaaatttataactaaccataatggacccaagaaataacaaaaagtttatatagccctatggctattaaataaattaaggtaattgttaaaattttttttgcaaagaaaacatcacaccaggtgattttacacgcaaatttttcccaatgttcaaggaagacatcattccaattttatgcaaactcttccatatgatagaaaaaaagagattattccccatagattctgtaaatcagtataaccctgttactaggaccaggcataaaaatcacaagggaggaaaattacagccttctctcacaaaggaatatagatgcagaccattcttcttagtagtatactcaattgtaaggcataacaaattttatttccaatatacaagtagcagtgtaacattacagaaagatttcattagctttggaatgtaccatttttctagctgtataatgtagcaatgttatctaatttctctaagactcagtttccttctttgcaaaatggctttttataatatctatctaattctgtgggaattaaggaagtaaacaatataaagcccttagctcagagtctggaagtaacagtaagcaataataagttacagcttctatttatcaagtacttagctccccggctgagtattttttttttttttaactctcctttaatccccacaaccaccctgaatggtggagattatgctcaattagtgaataaagaaactgagtcaagtggaatttcaacaactcacccaaagtcacataagttgcaaaaagtcacgctaatgtaacaatcgcagtctctgaatactgatgcctggggtcctttcaaatgtggagctgatattaccagctgctatcggggacacagcacttcctctgaggggcactggagttccttccacaaggcatggaatgtgttcaccttttcaggggaagcagttttcaagttggggtttgatttgtgacatgtgagattaaattgcagcatttctaatggaaaggcttcagagggcaggaatgagcgatacactgtcatttctccatctctgcgtgaggaaccttaagcactaatgagatcagatatgtcaccgcaactctctccactctgccacagattccaggtcagaatatttttttttttaaacattctggccacttcactgcctacctgcaactctctaccacgttcctgacatataagatttatgataatttaccttaggcagggcttggagttttattccaccaggttatcaaaaatgttgccaataatctctttcatattttcataggacaagattatacaaataatattccaccctattctttccctagagaaacttacatatcgattagacagggaggcctaacaaagattcaagagtcagtttgtcctatgagcgtggaaaacaccactcctgttaaagattacagagtgacgtcacttatgactatgctgtgcaaagtgctgggtttttttttttttttttgtatcctaaggggctttatgcttgtctttgtactattggtgccttgggaaggaaaacaagaatgcatttctcaacatttatgtctgcagcgatactgggaactgtgaatgctaacatatttttaaagagctctgatagagagaaaccaggtggtgaaagaaggtagtgaacaagcctggatacagaaaggtttagagtagaacttacgggcgccacctgctggtcccctgacaccactgcccagagcttccagttcccctaattggagtctcagctttatggccagttggctcagctgaatattattaaatgatttctgtcttcaactatgcttagacacagccttggagacaagtaagtaatgcagagagagtaaaagggagtgagtagatgtcaaagaatggtttgcccattcaacatatgtgtgactgctgtgaaaggtgtatgggagtttcccacatcatctatcagcaaaaagacataaatggtgatcttccttccttttcccaccttctttttttttttttttttttttttttgagatggagtgctggagtgcagtggagcgatctcggctcactccaacctccacctcctgggttccagtgattctcttgcctcagcctcccaagtagctgggattacaggcgcccgccactacgcctggctaattttttgtatttttagtatagacggggtttcaccatgttggccacgatggtctcaaactcctgaccttgtgattcacctgcctcggcctcccaaagtgctgggattacaggtgtgagccatcgtgcccagccttttccctttctttcttggagagaaatgatagcatctgaggaggcaggagcgaggggtgtcttgtggaggtgggtagtgatggcagcctgctctgtaactgaacatgcagggcaacgtggggagaggggtgctgcatggatgggggcagtggtgtttctagtgtgtgaggaagcagagcagaggatgagatgtacgcaggtggtgggcagtgaaggctaatattgaacaaatgagtatatatattaaggataatgggaaccaagtttctgtcagagaaggtatttataaatgtggaagggggaaaagacttagatttgaattgaagatactgatatgaattcatgtggcttatgtgtaaacatatacacatacccagatatggaaataataataagtgtgtgtttgtgtggacttatatgtacatatttcctagctctgtgttgactgggtctcaaagcattgacatcacaggaacaataagcatgctaagcacccagatcttgatttctaaaatcattctacacggacaggaaccagagctgcttggagaagtggctgattccaaggctggacagggacagtataagatgatcctggagcatcttttttgtaccagaatataaagaaatgctcaaagaatgatggggagatctggcaagtaccaactggaccaggtgatcaagtggggatacggtcagtgtggttgccttctgatgtgatatgctgagaagagctcagcagcgtttttgtggaattcctgccaagatggcatggaagaatacatgacttgagtctaataatgaagaaacagtggaagctccagagaaagagtcatcctacaggaaaaaaagacctatactctttaaggcaggaaaacacgagacagggaaagaataaaaatccattccaggctgggtgctgtggctcacgcctgtaatcccagcactttgggaggctgaggcgggtggatcacctgaggttaggagttcaagcccagcctggccaacatggtgaaactccgtctctactaaaaatacaaaaaattagccaggcatggaggtgtgtgcctgtaatcccagctactccagaggctgaggcaggagaattgcttagaagctgggaggcggaggttgcagtgagctgaagatcgcgtcactgcactccagcctgggcgacagagggagactctgactctcaacaaacaaacaaacaaacaaaaccattccagattggaggaaactgatgaaaaataataattaaatgcagtgtatgtttctgtatagcatcctggaccaaaaaagaaaatgtcatcactgagacagttggcaaaatgtgaatggggcctgtggactgaatggtagtgctgtatcagtgttgattcctgattggaagtgtttttataatagtaatgagaagagtgctcttgttttgggaaggtaatcaaacacctgaagagtgatggagcatcatatctgaaagggaatatctatatattgatctctctgaatgaaagagaattaaaatgttgcaaggtggataatcagggtgaaaggataccgcagttcttgctacccttctgtcggtttgaaacagcttcagaattaaaaaaaatactaaaagtgctgagctctgagaagaagaaaatagcataagtttaatgggaaaattatgttatacatgattagaatccttctttgttttctgagaagaccctttgttgggaagaattgatgatcaggaatgcaaatgagaatggccaaaggacagctagctgacttacaaaaagaaaaagaagattcggtataaagaaggagagaagggtgaccaggtatgcaaggagaaaaactgattgctagatattgagagagagtacttgcaaacaagcaaacagttgccatagggaatggaacttgtagggaaaagaaggatgttggagaaaagttgaataaattttgaagtgttaggtgtaatataattcttctgttattccaaatcaccacccataacatccacacccttcatcaacacccttaagacacaggtatttatttgtttaccttgtttgtttgatttaatgaaaagtatgagactgactggagaacaggtgcttggtgagcacagggcagtcagtgtgtatcagtatgtttgtgtttattatgaaaagtgagataaaacatctacataaatagttctaatacagggtagaacagaataaaaaggagccaccagagagtgtcagataaggtgtgaggaaacttcagaaaatagaaggaaaaagaatatttacattccccaagctccttctctgaaccagaaggtgggaattatacattgaaatagcacggtatgaaaatccagtaatgatccatgatcccccagctagtaaatggcagagcccaggtccatagaacccgaaagatctctttttttcctactatagtgggctgccttgtgcctgggtctgaagagaagaggaagaaagaggggagtctgatggacaaagctctgtggaggacgtggcactgagcagaaacttgaaacagagcttgactggctggcaggatgagaagaatggactcttggctgaaggggaagcaagcacaagcacatagagatgaggaagcatgggtggtggtatatagggtaagtgcaatctatttcaaagacagctaaaacacaagatgacccattccatggcaaacatggacaccaacaccatgtacaaagatgatgagggtgaggaagattgagacgtcagttatactgattgggaggctgtggaataggcagcactggcaatacttctgtgccctaatgtcattctctgaagctcaaggccaaacccactggggccaaactcacacagaaacatttattttcagacatcatttaaggaaggcaacacctgaaagatggaagggctcagtgcaaacttccagggtgctatttttgaaaatgcagaaactcccagtttggaaatattttcttaaaaatttccccatcattattagcacttctgccaaataatcactaactaaaaatattccctccttgataatgcacagataaggtctctgcactgaggaggaacaataaaggaaggtgatgaattgcaaatcaatcataatttatgcagatactctactgaaaatcacattcatcaccttttccaaatagcgccacatgaatttcctgaagtacaagaagtctattttcataaattagaccttaatttctttctctcatcaatatatttttatgccaaaaagttaaatagtaaacaatacagctgaggaagaaattatgaactagaagaacatgaaacatggtattcagaaggaaaaaaaaatagtcaaatatattttctatggcctttgctttgtgttaaagtgtgtgttttttccccaaaggattatgtgatgtaattggtactagttggatgatgaatataaacaaaaaatgccaaattatcacaagatgcctttgggaaaaaaaaaaacctgtaactgatgctacagtgtaccctgccagtatttttgaaagcaaaactgtactagttcatttttacactgctatgaagaaatacccatagctgggtaatttataaagaaaaagaggtttaatggactcacagccccacatggtgggggagacctcacaatcatggtgaaaggcaaaggagaagcaaaggcacatcttacatggtggcaggcaagaggccatgcgcaggggagctgccctttataaaaccatcagatcttgtgagacttactcactatcacaagaacagcacgggaaaaacccgctcccatgattcccaccaggtccctcccacgacacatggggattatgggagctacaatttgagatgagatttgggtgggaacacagccaaaccatatcaacaatcataacagcaatcagccagctaagaccaatgaccatccagcaagactcacttgctatttctctgtgttatctatgtcaaatggcaccttttttcttagcatcccgtttgtagaagagcagacacagagaatgtttcacaggtccccattctggggattattggctgggtatttaaatatacttttcttaggctgggttcctctaaagcaaaccctgaagacaagactttgaaggcaagtagttgatttagaaggtaattgcagaaatcaccactagtggagtgaggaagtaagatcgggagggaagaaaatgtgtgttattaaacatgtgattgctgtgggcaagagggactccgtttcactgggaaacactatagatacgtttcccagttattcctccacaagagcaaaggagcctgggtacttactcaccaacttccatgagtcattctgataactgctaccaaggggtgacggggtaggatgtgggctgggagattaaattcctagcactttcaggctagtttgcactgcacaaacacgaagtagacaccagtgactagaaaaagacaacagccagaatgtaatagtatttaaagatggaagccaggggacaatgtgtagaggaatagtcctatccgaggaatagtcctatccaaggaatacgggcagtacactgcaacagggcccttttaaggtgagatatttagaaacctgggtcaatgcttgtctccatgccaatgcagttacccactccctctcagccccagccactctacgataaagtcttaatgaacatcagagggacgtttcagggcctgctttgtgacgcacatcaccccttagactactccagtgctcactgatgtcccaaataacaagtcctctaaattattggtggtttggtctaattatctgctgaaagcattcaaaaccattgggtatccctgaaggagaaagtcacaatgctgcataagaagaaacaacgcctgcaacggataacttatttgctgtcatatgatcctatagcatcctacagatctccttccattagcatccatcacatctgtaattatttccttttcattatctgtcttccctgagtgaccataaacccaatgaagccagagaccatgcatgattattcattcacagctctactccctgtgtctagctcatagtagggagtcactcaatacttctgaatatgaaaacaagtgaatgaattaagattattaccgtcatccagcaggcaaaatggattacatagctaagggtctgttcttctgaagtaccttcttataaaggataaaaaaaggtgctccttcttccaggcagatgaagctctgagccagagctcattgcttaaccaaagcattgcagctcaaattcagctcctgctcacccattggcaaggtgcctgcggtagttttaagagccatcaacaaatatttctagcttgtcttcttcctgctgaatgaaaagtttgcccttccctgctcccttgaaattagatgtggccatgtggcttgccatggccaatgaaggaaaacagatatgatcccattctaggtggaagcctttatgagttcgtgcacaatttaccatatttgtttctttctgccatgacaaccagcaagatcgcagatggcagacagtgatcggcctatattcttaaaaggaagagacatatacacagtacctagctaacccacaaaaggcatatgatatgttttggctgtgtccccacccaaatctcaacttgaattgtatctaccagaattcccacatgctgtgggagagacccagtgggaggtaattgaatcatgggggctggtctggcccacgctattctttcgatagtgaagaagtctcacaaaatctcatgggtttatcaggggcttctgcttttggttcttcctgattttctcttgctgccaccatgtaagaagtgccttttgccttccaccatgattctgaggactccccagccatgtggaactgtaagtccaattaaacctctttttcttcccagtcttgggtatgtttttatcagcagcatgaaaacagattaatatagcatgttagaaatatacttgtattgtttaaatattggcgctcttcattcctgcagcatatctagcccactctggctgatctagtatacaacccgcagccctatatcctgtggccctgggcaggttaacacgacttgcagtttctttgttctcatgaactggtgttcatgtcataccctcatgcatgcattaccctctctctgcacacaacgtgggcctctaagaagcaatgcttttctgtggaagaaggaagagggggcattcagacttaaccctttctgcctaaaaggcccttctgaaattatatgaaagagagagagaaaaaaaaaaaaacattttgcatgctgttcatttagaagggaggcctaattctttcaccttcctataatctccagagcagttcctataccatcaaggctgcctctcctgagggggccagagcttcaggctcataattagttgtattactactactgtcactgctaattaatgatccacattcagcctaaattgaaactgcccatttctgactcctccactctaggtcaaatagatggttccttattttcaaattatgtacttcatcttaattgtataatttcaatttcatttaaaaaaagaaaaaaattaaaccaaggaagaaatgacattttctaaactggtgagttgggttatcaaacttaaaagcataaaaaattaatactgtgggattagcattattatagaaatacattaaatcttatatttaaataccagtcttttaaaccatggctgtcacagtgaaaatgttaatagtatttaaacataaatccttctccccatgaagaatcattcatcgtgcaagcacgttagctattctattcactttagagatgctgcctagcagagcattttaacgtaagccttgtcagtgttaatcctaatgtctgatgctgagatgtgtgttatattactttatgtagctgaaaaatgggaagcctttatgtcagattacaggctgaaataacgacctccccttggagccagggcctgggatataacgaggtgccaaatgggattctaggtcagagcctctgcaggacataaaagggaacagatcttttgttaagacccattcactcactaacagaatgcttttaccctttgcaatctactttatggctcctctgcaaagaagagtaaccaagagagaaagtcttgattcacagtggggcttaccagccaagctttggattcaggcaggcgatggtggaaatgtacccagccactccttcacctccacaaccaacagtctagggctacggtgttcaaattgcattcatcaaattcagagtggggagtgagagcctgaggttcggcagaggcaggaacggggagagagagcatcaaagtggatccagtgccttctccatcctcactgcatccagagcagttccctctacatctgttttatataccacagttttatgaaagatggcacatgaaatatggttctcctgttaaagtaactcattaattcaacaaatatttaccagccacagacaataaacccctgaataaatgagcacatttcagagagtgatagacgatacagagaccagcaagcatgatgatgagatagagagtacctggagtaagggccacttgcagagaggacagggaaagcctggctggggtttggtggggaatctgagctgagtcatgaataagcagaaacagcaagccatgtgagatccaggaagaaccattccacgcagaggaagtggccagtacagacagcctaaggcagaaacaagcttaacgtgtccaagaatagaaaaagggcaatgtaactgctattgggtgaataaagagaggcatggaaaagatgaggaaggcagatcattcggggcattccagactcaaacaaggagtttgggtgtcattgtgtagtggttggaagccaatggaaggttgacaacgggggcatgacaaaatctgttttgcggagttcttccacacagagagtagattccaggcacaagaacataggctggaggatcaacaagaagactgttaccttccaggacctggaagagagttgcagtgaagatggtgcaaattatctggatctgggatatgtctaaaagtaaatctgatgggactaaaggattacttgaaatcactaaccagaatttgagaaggggagggtggaacacgtggtatgtggggagggaggagatagtgcttagaaagaatagaataattgccacttctgtagatagcttctggccaactgacttagcaaagagcagcacaatatccttgggctgagaccagcgggtttgccactgtctctcaccggcaatcgcattcttgcttccaaatccggctgataatttaggaaggttttatgtcaccgctgctcggcttctttttgtgctttgattacctattctcatacaacacttaaaggtggtcacagaataatctctaatgttttgctttctatgataaataaggggttcgtgaagttcattaacagggattgcatcaccctccaccctcttttacaaccacaccataaaagtagcctctaattagttaaaagactacaaattataccatcaacgtgaggtatggcaaaatctgatggctctaattatcttaataatcagcagaaccactctcaacctaataagagaatgagtcattagtggtagtttatgaagatcaccgacattctctttgttatggagtttgtccttcctgtgttaaaatttggacacactttctacttgaatctaaaaaggatgatttctaagaagttactgaagcaatgcaagatcaaaacataataaccacattcattcttaatcagcattacagtgaaagtaatttaccaaagaacacataattaagtcataaatgaaatctcaagacagaaattgctccccttttaagatttctcattgtccatacactcagaaatgagaagagggattttctcattctgatcctaaatctatcactgaaatgatgacttcacttgcatttatgcattttgctttattttgtgattactttatctcactatcctcccctttttctgcttgtgtgattgccttaatccttttatctagaaccagggggagttccattagcttcagctttttggtatgccttagccacagaaaactattttgtgattcaaaactgctctaaaattcaggaccaaatatcacatattatgtactccctagacttttgagagtttcactctagattatagaggacaaaatcatctccccacctccaccttagggtatgtactccccatctcaagtcataagataaacctattgtggtcagaaggcagagtactctaataaccttgttatagttgaagagactgagtccatgaaaaagttacggaccaaggttatacacagagctggtgacagtcttgaggctaaaacccaacgttttactcttagctaatgttcttttgggcttaatgaatgaactactgctgtggaaatgtttttttttttttaaaaaaaaaaaaaaaaaaacctttcattgtgttttgccagaataaagactgaacatggccctagcggaagagctaaattcattatctttaaaaaatgaaattttctcaaatcataaatgcagtcaccaagtgtaccttctttctctgcattgcagtacaccaaaatgccagtcctctctacaaacacattttatggatcccaaagcagagagattgacgttgttccatttcctgttcacagtataatcaggacaaaggaataagattagtattgtgccatttccacgcggaaaaaaaaaattgttttctccatgtgactgtcagtgtatgtcaaaatgataatggggaatgtgtaatacaagatattgctacttatcaatggactctgaaaagaaaattagctcaagcatcccttgatataaaaagcaaatatgaggtcttgaatcacaccatcctgctatcaacatgttttgttacaagtcagtttatgttccttgagtaccacgtggtttacagtgcatttctctgacagcaatacagaacctcaaacaaatattacccttgcctccaataccaaccaacattaaatacaagttctattcctgaactcagtggcattcagaaattcaaaatgcttagatgccctctccatcgatttgcttctctgggtattgggctgacttcctgttcatcagggggtggtggtggtggctggaggaggaagtagatggttttaaccatttgtaggtctaattactcaagctcagtgagcccacattgaagaaggagaaggagaagaagaaaaattctctttcctattgttcatatataaaatcccagggaaagattctaatcaactctgtttggatcacatgcttactccttgggccaatcgctgtggccaagggacagtgtagcttaattaggcaagcctggttacattcccatcctgttggcttggaaagggggatactatgaccagtaaaccaccccaaatcatatgaaatgtaggagaacggttatttagtgaaaatgaagcactattatcagaaagagttggaagttatactagcagacagaaacaacaacactccactgcctttcaaataagtttattatgaaatgaaactacggctcctcttttctaacagaccgattttgtgattagaagtaataggtttttctcaaccaacaagctcaactagtttagctctttctaccagatgagccaagaataaaggacacataagggtctcaaagattatgctttctatcctgcccaaattctgtaaccattaccttttcagtaggtgatacatttcccaatttagacttcacattatagaaaaaaaccatccttcactgagttgtatttgataccgaatgcctgcattttcatgtactagtcattattccatctttccttaaagaacatccttttttttttttttttagacagagtctcgctctgtcgcccaggctggagtgcagtggagcgatctcggcatactgtaagctctgcctcccgggttcacgccattctcctgcctcagcctccctagtagctgggactacaggtgcccgccaccacgcccagctaattttttttttttttgtatttttagtagagacagggtttcatcatgttagccaggatgggctcctcctgacctcatgatctgcccacctcggcctcccaaagtgctgggattacaggtgtgagccaccacaaccggcgaaggatacccatttttaaaataccatttaatttaaagttaccagatgaaagctgcccactgtaattccagggaaattttactcttagttttcttctttatggtcacccaaatctagattatttgaattcttcttctgcagtaaaattaattataatcatagcttccaatttttagctgctacttattgagtgctgactattcttggcatcagctatattatcattaatcctcataccagcaattattatcatctccattgtatagctggggaaactgagatagagttcaaagaatttactcaaggtcatacagctgagaagtgacacatcttggaatcaaacccacctctatttcactaccaaatgccttctcctaactatatactctacccctgcatcgcgagcatcaggcaccgagtctctccaaggctctgtgataaatactactcttgtgtgacctcatgtcaccctcacttttcactcggaatataaggattcccattcccatgtcacaggtgaggaaactgaagcttaaagaaattcatcaacagacctagtttgccctgtatatagaaaagctcaggtagtctcatattttaatctctttttagcctccttttgttttgtttcactcagttcagtcttaacgagtcttaatagtcaagaaaataaaatcatagtaaagaaaacaacaaaggtatctcataaggacaagaactaatccatcccactcctactgggctggctccttttggcagtggtgattgctttctcagatgtcttaatagaagagagaatttgtgaaagcagagagccccattaataaggaaggaagaacctgcaaggtgcaaataactaatctcttgttgctttcctgttaaggtaccatgcatgtgtcaaaaatcaaaaccagggagcccagcctctaatatgagaagattccagatttcaaaagcactaggtactatttgataaaccaaacattttccctgttattgctagaagcagacacacataggcacatttgcatcctctatattgatacttctcaaatcatccatagtaaagggcgtgtgtgtgtgtgtgtgcgtgtgtgtgtgtgtgtgtatttaacctctatttacggcagtctgattcatgaccctactgtaaatgactactacatagttcataccacatgtgacttgccacacaagtctgatcacattggaactggtcttctccttgttcaataggataaggccaccaattatatacttggatgtcatggtgacttcaaattgctataaagtttcttatccaagactgacaacttgcatttcttcaggactggcactgatcctccagcgacattttgaatggcctactccataattttttgatacagggtagcaaatactatgcctatagtggcaaggaagtgtgtactctgctgaggaagtcacctctgcagccaccagaatgacatttctgaagccagtgagagcaatatcagagagcatcaatattgtaaatacgttttgatcttatagataacctgaattttgctgtgtgcgctattaataactaatatttgtaagaatctcaacaattttcaaaatgctctcttatatgttaacaaatgtagccctactacaatcctgtaacatagtatccttacccacccccccacacacgcacacatacaaagaccaccacctccaccccatttttcagatgaggataatggggcttagagtatttgggtgacaaggctaagctcacataataagttttacaggctagcaggaataacaccaaagtttcattttatttgcccactccaaagaactgataatgacagccagccaggaagctacttggaggctgtgtctgggttcagtgggtaaagagtctttgagagattagcaatgtctgccgggtaagaccagatacactggatacccttggatagattccaatccaggtagcctaatttccttttccacatcctttagcactccacatagagttgtttctcacaagtatccacatttaaaagaggtaacctcccagaacagaaactagctgacattttggaggcaaagtctgtttctcttgcgcactgaagacaagaagagtcaatttgtgatacgtgttacagagataatacacatctaaacagcggtgataaatgcatgggaattacaggcaaaaccaaggtgatacaaagtttccaaagattagatgtatctcagattaaactctccagattatactaatcaattacagaaatggggctgagtgggagtagtcactgaagccaccgttgatgtactttccctaaccattttatgcaggcattccttcatgggggtctcctcaagtcactggagtcctcagcaggggaaaggaaaacagcaatagagaaggaggttaggatcttgggcttcattttgggagtcacagtactaaaacatcacctcatgattagcagataaaaggtgctgccctgggctcaggcaattacaggaagaaacaaccctaaagcagaattcacaacatactgagttcatgaggagggcgatgaggctgatgtggggactggcttttcttcttggtgactcaaagacaaagccagcagtacttatttaaaacatgccacgtgctcatgtttatgtgaggagtagaagacaacggctttggtaaaggagaaaattcactgcataattgaatctttgaaattccagagggaatggccttttctgagaacaatgtctgttattaacagaagaatttcgaggccaaatgcagagttttccaccaggttgcatagtgagagtcatattttgaatggatatatagttttttaaaaaaagaactctgaagagttatggatgtttctcaatatctttctcaagaaggcaacagattttggactcagcagataaccctttatcctatagctgtagtgatgatgacatgataagctgtgtagcctgagcttagatgcagaagtgaattctgggcaagggtcccactaacctgtcttccctgggctccagacccacatccctagctccttgttgggggctccaacttgtacagccagcacatcaggctcagtaggtacaaagttgacatatcaattttcccatgaaaagagatcttgttttgacaacactagtctttcagttacctagactcaaaatctagaagcagccctgctcaccttcatctccttcacagcctgaactgagtcaagggtcaaatcacatagctgggttagagatatttttgacacaattccttccttcctttccacccactttgagttggcacttgcttaaacactccctgttttacctctggatagttacagtgcccctcacttgtttcctcatctccagtaattatccattccaacccatcctttaaacccatgccaaaatcactttcataaagcttacctccacattcaaatctcagtactctaccaggcacatggtggctattcaggtaatattttctggatggatggatgggtagatggacaatgtatttactcatcatttactatatgcctgacattgtgctgggtattaaagacagcaggaaacaaaccaacttctaacaaaacacttccctgctcatgagccttgaatggccaattaacataaatggttcattccagcattcaagcccttctgcagcacagccccattctaattgtttcactggtcacctactctcccatctgtcctctagccaagggtttctgaccttagcactattgacattttgagccagacaattctttattgcagctgctgtcttctgtattacagcatgttgagcagcatccctggcctctacctacttgatgctagtggcacacagccccactcaagttgggacaagcacacatgcctccagacaatgccaaatgtgccccgggggagaagagtcgaaaagaacccaactgagaaccactggtctagggtggcgcccaatttacacccactgtcctagggaaattattaatagtactcccctttcactttcacatgtgttccagtttagaagacaaactagattggttccctgcttaaatctcccgagacagcaaccttgctctgttctcatgcagattgaagaggaaagcaacaaattagtatgaagccttcagcttccaagcaacacttttttttttctggtgaaccggtctcctctttaaagattcaacttctctcttcttctttcagcacatgcagtactgggaagtaaaactggcccaaatgctctgcagggaaatgtgaggatcataagctatcctcgcctctcaaaaaagaatcacaaaaatatttacagcttttctcaaaaagtttcatgttccaaagatccccttctacgtcattctaaccccaaatgcctcaaaaagaagttcaaagctctcaagtccatcgatccaacttcttctctggccaaaaaacaatttcgtgccatgtgttaatgcaaagggctcatgctgtattcacgaaatgccaagacacctggttaaaaagttcaaaaaagttaaaaattgatccataatttcgactagcatggtagttctcaagctttactgtttcagaattccctggagtgcttgctgaattggaggttactgagccccagtcagcagagttgcagatttagtaggtctagggtgaggcacaataatttgcatttccaagttcccaggtgatgctgatgctgctggtccagggatctagaagatgcccgctgctccctgcttattccctcacagactgaaacgtacgatattacggggttaggacagtgggcttgggaaagaagggagggaggtcaggagacttcatccggctgcttgcttaggttttgtgtttttcattttttttttttgccagttagtcagaagaaaacgattttaccctggcctgtgctgggcaccatgctaggcactagggatgcagcaagaaccagacagaccttgcctcctgctgttttcccctttagagccacaagctcttctatgggctccaattccattccttctagcactccctttcagttcatcagctgctaatcagcaccttcaatcactctccaaatccccacaagacagcttccatttttcaaaagcaaagccaaagggaaaatcaagagtttttagaagcatctcctatttcggcaagtgcttccctttttgactctgatccatttcatcaaaaacccttattagagtggtccttcccaggtgtatctttttagttacctctggagataggaggtgcatccagtttattctttctgctttgtttcctgtccagaggagaagagtgctttgatccaacactgacaaccacgtctgcaggggcctcagacttgcttccagggaacaatcactcagcctatgattttgaatgcttcttttgtcactgtcaccaaagcctgagggaaagcaatctacacgctggttgacctctgaggcgactgccagaggtgccagctgtttcccctaaactactactcactgttgaatgtctaggtttccatctcccagggaagacattgccccagcttacctcttcatcatcatttgggaaggccagagaagtgtgggcgaagccatcctgcctggcgtcctcaagactcttgtctgataccagggctctctctgggtctataatctttgttcagggaatagggaaaatgtcctgtgatttgttaatccctcctgtgcagtgagggggaagttttagagtaactatttatatttttgtgatatcaggagcatctagatatctttgcttacaagtttttttttataattttagcaaaggaaaattttatagtttttagcaaaggaaattttacctttcatcataataaaaaatgtattctagaggccattattcatgggttaatattatcagggagctaacgatggcttaacaagagatgggaagccattttggaagtgttctattatggaaagagggagggcctgtgacatggattcatatatcatattcatatggattcatatgccagccatgcgtcagccatgagtaacatcatttcttaagatgtcagagtttttcccaagcacatatgccctcaggatgagaaacaactcgtctgtttgataaaaaaagaaaaaaaaaagaaaaaaaaaagattttagttcaagaattttatagattacaaatttcagagattctttattccagtatagagacacagaaatcaaaaagaatcatcactcaaatatacataggtctattaggtggggacacctggtagatgtaattatagtttcatatgcctgtatttaatgccactgaactgtactcttgaaaatggttaaaatagtaaattttatgttatgtgtatcttaccacaaatatatatatgtatatatgcagaaaaaacatatataaatatatattcattaattaggtatctgaatagggagctatgatcttaaaaaagattattttttcctaaatggcaatgtgaatttcatgtggcttaaaatcttctagtatggatttttggtgtttgataagctacattatttaaactagaataatctggaattatagagaagtatttggcttctggggccactgggacaggggcagggagggagtgtgggagcagcacccctccccagcccctgctgctgtgggagttgggatggggatggcacttccctcaaaggagaccaatgttccattgtcagtcaacttagggcacaaaacagtcttcaagagagaagaggtggaggggactcatacctttggtgggagataagcccctgctacagggtaacacaggtgaaggtcaaaatgactagtagagaacacctcctgccactaaggggtaagagtagtaacatgtaaaatccagctttaagctttactttcctgtgttagtatcagacactgctggttgtctacctactttctgttcccccttcttacctcactaacgtaactccaattttgagaggaagctaccctttttcatttgttcaacttcttcttgggaagctaatcttacccttgacccaactggcctaagccactgataggaataggaagatgatacaattccggtcattcacatgctcagctagctgaggagacatctgtgaaacagttccttgtccatcaaaagagacacataagaagaaatgagaatcattcttttccaactgttaatgggtctagataggatggctatactactgtagttattgtgtgaccatgaagtgtgctaaccttgagccagaagccaatgcagggaaattgaagagtagaaagaagggaagatgttatattcttgagtatgacatttatgcaactgatgtaaccattcattatctcaaaggtggaactatcctacccttaaactccttactattggaactttttgaatcatgatttctataatgtgctgccaaaatcattctacttaactggttcagaattgtaattctttcaggtttttcctaaagccattgaaaaatggtttgtcataaatgactgtgtagagttgacagggcctttggaaaactgagtgggtgctgatgaccatacagggataaagtggtcatggaacaacctctgcgacatgaagatatggctgcaagcagcaagagataacaagcaggaaggcccagagcagtgatccatagcataaagtgacaagtgacaggagggacaggcttgtgggacatgtaaacaagccctatggttcttcagaaatacgagtggagaggaggtcatttaagacattgaccatgttcagacatgcagagtagaggcttgggctatgatcatcagataccaaaagaaaaagtaaaaagatgaagattttagagggattcagataatactggctataaggaatatcacaggatctcctgccaagaaaatgagattcctatatgatttcttatatctctccatatgtttcctataagaatactagccatcaaaatgacaaattcaaattggtatattcagacaaatagaaagaaagtatttccctatccctcaaatgagttggataaccatgaatggtgagtcagatgagaaagaaaatgcaacagctctcactcagacctggacaaaatgttaaaagatttagtaggatggtcaaaaacatagttttcaccttaactgcttactttcaactcttcattggaataaatgcatataggccaaattaataaggaataagtagttatattttaggttaatagttgtaccattattagaaaaaatctgcctcatataaatgcagccatgagcacttcctcccctttaaaaactagtataataaaaggaatgactgattgtacttggcatatttcccctctctgtggttgcatttcactgcagttatgaaaacataatataatttttcccaaggccatggttacctgacagaagcatttaaaaaccaactacactttggacttccaggcacgtgtgtgtgtgagtcataagacagttcagaagagaaattcatatttgacatccagagctccatcttcccgcctcaagtgtctgtgtggatgtacttactccagtcttacctgagtttcaataatatgggtttgtcacaggttgttatgggctctaactaacagctgtccactgcactgagaactattattttcagaggcaggtcagaagcccatttctgactctcacgcattgtaaagaaatgctgaccccaaagtgggattctttctcaaatacactcaccctgtaagcaccaggtagagccaggagctttcaaaagtgctctgagtttaaacatttcacagcatgaggaacacagccgaagagaaagtgcaagaaaaacaatataaagacattattaactgtgtgatcacacaagagtgaggcctccagatgggccacctcatagttattgacgagcgtttagagaagaacattcattactcgatattgacgctaacgagaaagggtttgagagcaagtttaaaatgtagaaggaggaaacacccaaaccccatccccatggcagctaattcactgttcccaacaattctgcatgctattttttttactccccttgttcatatcttatactgtgattaaacccaagcattctgactgtaaaccctttttttctgtctatttcgcataggcttggtgtgttaatcaaactgtcagcaaaggaaaaaaaaaagaagaagaagaaagggcacattctatccaaatgaagaaaaatctgagctttctacaacaaacacattttccagtggatgagcttctcacacagtaattatttcacttctcccagagattactgattacatcacacagaaaaactaaatgagggctgttttatctttctcatctctctgtggttcttgtgcaaacttatacttgttatcatgaaaaatgacaaatttgccatctgatcaaaatgttaacaaggtaactgtcagtgagatggatctctgactgtcactgcaagccagaacatgaggatacattgatatttctcaatacagcccctgcttccccaacgttcactaactacatttccacagtaaggtaataaatcactcagaaataacgagctatataggatctctggggtatgatagatgtgtcctaacagcactatctgcaagatagaaaacaattgataatgatctaaagaaaaccctaatcaactgccattttccataatggggtagatgaagcaaagatatgaaatcttaactatgtgatgcatgttatgacaaaaccggactgctccaaaaaaaacccacacagccccaaacaaaacacaaatgacctaacattacgtagggtcgaataaatgaaaaataaagttaataacacagtctggatacaaacattatattggacactggcaatgatgggataatcacagcaattgctgggtccacaaacagctaaatagtggagggttcctcatataacatgaatgaagactctggctcagttattggtttaatgaactctcctccaatacttttatgttctttaagactctttgggccacattatttctgagcctttaattcaatggtttaaccaatcatttcccccacccccccccccccgccccttagcaacgtggccaagtgccacatccaaaggaaccaagagagaagaggagaagtccatatggaaataggaggtaatcaaagacagaacacaagatagaaaacttctgcaagaagatcatggcttcagatcacagggacaaagaagcatggcatcaaactgccaagaagctgcctcataacgacatccctttaggttttaaggttaagaagtctcacatagccacagttggtctcctgcctgtcccctctgctcgtttgtctttggccattcctgcttctgctgtttgtagaatactccaagcgccttccctccccaagaccttgtgcctgctcttctctctctctcagggatctctctcctccctggctccttcccttcatccagcttaaatcttccccaaggaacctgccttgcccttcggtttcaaagtagcctctactaccacccctttggtctctatcagcttcatcgatagcagaaagaaccatgtctgtctggaccactgtaatttccaggcttctagcactttctcttctctagtagggattaagcacagtcccaatcctgggctctgggatacaggactgactagccttgaatctagtgccacaactaagtacctgtgtcccactgtgcaagcactcaatttctatgtgcctcaggtccctcatttgtaaaacagagagaatagcaatgcctataaatgacagcgttttgaagactaaatcactttatcaatgtaaagagcctgagatagtatcaggcatacaggaatccatcaatcagctgctgtttttataagagcaagaacagaggtaattcagacataaagtgaattaattcatgattatagacgttagatcaatgagtcaccttcatcattccaggtttttattttaccattagccaaaacagtattgtgctccttctaattccatattctcagactacatggaatgaatgggtattggtctttaagcctctttgagcaatgccaataaatacagtcacttccaatttgagggcacttggaatagcagtgctattgttcctttgacatctcaacagcacttgaaagtgaaagaaaaaaaaatagattaatggatgtattccctaaagcaacaaacatgtttgatgtataaacatatgttatgggcaatgacgctgtacctttggtgccacgtctcaacaattctcttttcatctatcccctaatcatgcaactgaatgcttccagtaggccacacagtagggacaaaatgatagtaagaccacctggctatagatacctgcttctagagaggccaggttccaacccattacaagctgataaccatatgtatgatttttgctacactggccaagtatttggatcttttttaaacatatttgattatttaccctttgattagaatttgtgaataaaaatgtcttttaagagacacaaaggaagggggtacgggcaatagctcattactaaaaatcattttagtgtggaaagtgggcttcactattcctataaggcagtcattttcaaacttcagagcatcacaagccccctgttagattctaatagaaccctgaggaaaatgcacatacacataaatgttcacatataatttctacaggttgaaggacctcccaaaacaaaacaaatctatcaaccacaaactccagtgtaaaaaactggctctatgaagacttcaaatcaccctcacttcctttgcatataaccatttttttcttcagacaaataaaaaatacaattaagtttaatacaagaagaggctaaaaacattaggatagaatattagagtttaaagatctttgcctggttatggtctaaagatatttgctttgattaatatatggtgtaactcattaattaaatgcaaattgaaataagataaacctgtccccatatcatttctggtagacaataatgtgccagttttctctccaataaattagatgaggcaagctttctgttactaaataatagcaatatgggacaggagaaaaaaatttaccatgaggtgctttggaattattcacatgaagaactttttatttcttactttctttttcactaaaatagtactttttctcattttcaaccaatttttaaatatgaggtgtttacattgcttactgttcaaattagcattgcatactttcaggcacagacatgctcaaaataggagtcttttgaaatgcctgcattcagtataaaacacactgctggtaggaaatgcaaaatgtaaaagtcttaaaatacatttagatatggaaaacaaaacatttaaaacatattcacactttaacatgtttggaagtataaagttaatatcgtttatgaaacaaatttcaggaatcatactattgaaacaccctcacatcttcaattagctggattaaggaaaaaaaatattaacaatatttaaatgcagaaaacagattatcaggaagagagatcgttatagcaccttgttttcactaacaagcagagcagactgtaattgagttttagaaatccctgaggtggtaactcggtagagaaatccagacttggcaaggaaatcaagtttccctttaattacattatctcaatcaaagagataactttcacatccctacaaagcaaatgttttaaggagaagtctggcaaggaaagtaggtggaggtacagaggggttaagagtttcaaataacttcatattggtaggaggaacatgtagaaaactgaagtacactgtgaggaagaagacagatgccctggcaaatggtgctgctcccaaaaacatatgacacctaacaccttggtccattggtcctgctttcctatatcagccttggttttgcctttgtcactgaagaaacatggcatgttccttagtgttgaacacataagcctaaagctgatctacagtttcttaagctgataaaaggcaaagctaaaatgactttggccatgactatgctgttcggaggaggaaaatgagaatgttcagtggaaattattttcttggcagtgtccttactaggtcagcaaacctccattctttccaaattttccgggtctcctgcttatttcaggacccatataaggaggatataagcagtgatgtgtgagagctggtttgtaccagatcacaagagctgtttgtataattttcagaaattttgtaagctggtagcttaaaaagccattaaaaattaaattgtgtaatttgaaagtaataaatattaaaaacaaagggaagaaaatattaaaaactctgtaattcctcataatgtcactacattttactattgtctatgctcttaggttatatacatctgtattagtctgttttcatgctgctgataaagacacacctgagactgggtactttaaaaagaaaaagagatttaatggacttacagttccatgtggctgtggaggcctcacaatcatggtagaaggtgaaaggcatgttttatgtggtggcaggcaagagagaatgagaacgaagtgcaagggttttccccttataaaaccatcagatttcaggagacttattcactacgacgagaatggtatgggggaaactgcccccatgattcaattatctcttacagggtccgtctcacaacacatgagaatcatgggagctactattcaacatgagatttgggtggggacacagccaaaccatatcaacgtctattgtatcttgtggtggaaatactctcagtagtgtgctaccgcacgtctctttccaagtctgtgcagtgacatcaggtttgtagcttcaattcagccatatgaactggaaactggaaacactacagattaactgttttcttggctatctagatttaagaaagtgatgggggaaaataatgattatggagacaaagcttaaaagcatattgtgtcaatagctgttacatggtgaatagtacaaaaaattaagaaaataccctttagtgttctatatctattatctgatttggcaaaaatgtcactcatatgattgacaaatgagtaaagttttgacatatattcttaggcttcacttttgtcttgtttatgtaaacaaaaatgtcaaccaatattcatgtctgaagcacacctgttttgtcagtgacatgagcaactttgcttaattgggtagtaaccaagcatttattccttatctgaattttcaaatcatggctgaatcacaatcataagttgactgtgattacaggaattcaacaaacattaacaaaagcattctgtgagaatcaaattggctatatagaatctatgataaagattggtgtatattttatgattactcacaaattgtgtggtgcacattttatatcagtaaaatttataataagcagtcagatgtatgagggtatgtggatatatgtttttatatatacacacatacatacacacacatgcatacacaaaaaccagttgttaatatttaccagcacaccactggatatcaacacaataaagatatactttattgtgtatctcagcaaaaactgaccactcaacttttctagggacaactttattatggttggaaactagaggctaagacatttattgtgtcattgttgaagttccgtaaaaccatttcctatctctaaagttatttatttggctataatgccaagctacaccagctacttccccaaaagcaaggctaccagatggtgacagatttgaaagctctttctcatattttgagggtaggtaggggagtcacgctatgggacagtaggaaaatccacttttagcaggcaggatagaatgggagaagtcaacaccttgtcagttgccaatgagctgctgagaagtagttacagggtatatagcaggatagtattaaactgaaaggtcattaatgtgagatccttgggacaatatgcactctgtatgtctcaataatgttaaaagattctgtacaatatttgattgtatccaaatagtttataactgtaacatttaatttcaaggacaaaaatgaacttaagtcaactattcctgtggttttacatttcagagagcagtaagaaaaattcaccaaaacaaaataaagcaaaacaaaaatggagtgccaaaacagatttgctaatttttaaaaatgtgttcaaataaagatattttcaaatccttccttttattatcacccttatggcgcaaaagaaagctcatcagtttgctattaggatcatttggtagcacacaaagtccattttctatatatgttcagaagaggaaacaggatgagcattgggctcagccactggagatcacagcttcatcatggttcaacctcatcttcagacactgaaaatattgctgaagaaacaggaagcagcattgagcacggggggctgccatgtgtcctctccactgaagatagtctgaaggatacagtgaccgcaggaacaaaaatgccctcagaaacagccctaaagggcttctagaaagtacatgctacctgatgctttttttttttttttttaacgattgatgtctctgatttgatttggtccaagctattctgagaattcatgatggaatgagaacatcagcaactgcagcctattggatttcggtttagtagagtacagtgctctgtttgatcatccacttttcaagagccagcttcacatcctaactgcatcatccttgcaaagctctgctactttgaatgctgctttttttcagtccctgaaatacatgtgcctggggtgtcaccaacaggtgggttttttcctctgacttctttccatgtaagcctcaaggcatgtataaaggacatgagcgctgctttcattttccaaaagaaatcagctttatactgggaattgcaagcacgtgccaggtttcccatagtgacttatatgaactcgcacatactcagggtgagtaaaactagcaggcaggcaggcctcaaccaagagcacatttgctagtttttcttgaaatgttcagaactctggccctaagagaagctaatgccaggcaatcccttgcaaggataggagggttatgggatcaaggcaaaagacacatttggggaacaccattccattgggcaagctctgatatgcagaatctaaggcagctttctggacctctgaatatcatagcatcgcagtggcttcctgtggctctgtggttacagaacaatttctaccaaatgaagagaatgacagaagcaaggacctccacattcctatcatatgtgacagtctggaaaaaggcagtgttcattcttacctctcctaacttcactcgctcattcccaggtgagcctgaggccacatttcacctgagcatcccagctcctacagtcagaggaaagaacaaacttcactcccactgaattaggaccaactatttactagacactgtgcaggtattatgttactgtctcagtctgtttagttgtcaccataaagaaatacctgaggctgggtaattcaagaagagaagaaggtttatctggcttatagttctgcaggctgtacgagaagcctggtattggccttggcttctggtgagggcctctggctgcttccactcatggcaagggtgaaggggggctgtgtgtgcagagatcacatggggagcgaggaagcaagagagaagggaagaggcaccacactctttttaacaaccagctttcatgggaactaacagagtagggagtaactcaccaacagagaggtcattaatctattcatgatggatctaccctcatcacccaaacacttcccatgaggccccacttccaatattggggatgaaatttcaacatgaggttaggagggcacaaacatccaaaccacagcaattactagtcaattatttccgcagtccagtgagacagttttctgatacttgtttacaggacaagaaattaagtcttttttgtctattagacattcatttattgagaaccaactatttgtcagaaatggtgctgcagggctaccagagaaccagacaaatgtggcccctgacctcatggaatttgcattcctgtggcactcaaagaagtgagtacctaagcagtcagtaaataactttggctggctggttggctaagtgtgtatggagcagggaggcttggaagggggaaagtaacaacatggaaagaaaagcaattgtgcagggattcctagataataagccaaagacccagaatttgaacttcagcctaattcacttttgactttatcaagtgacatagcctcgcagatcccccatctcttcctatctcatattaaaaacgaaccagagcaagaacagtagcagtggaatctttcccatggcccatctctgttcgctggagtctgagcaccatctttgggccaaaagcctggggaagaacaggatctaaattccacatttgtggtgaggactagaaagtttcagaacattgcccttttaaactcatctttattaatattctttaagcgcacaggtaatgagaaagtgcaaatacagccccctctggctgcagcagtcagagagccaagaaaaaactgcatgtcatgccatcctattataataacagattaaaagggcacaaacagggtactaattagcagtcataaaaacttgaagctccagattgctcatcttcatatctgggcagtaaaagtaccacgtgtgcagataacatagaagtaaaataccagggtgcaattgcccagagctcagccagcatcagctgagagaagcagttgcatccagcagcacatcctacactttctcaagaatccaaaggcattcaggtgactgcccaagaattaaaaatcagccagcccagagagaggcaagtgcctcctaactcagcaagggacagcgggagaccttgccaacttctgattgatcgtcttcaattccctttctccaagatgtattcctgtccatggtctctccctggattttatgcagaaagctacttctgagaaatgagagggttttattagcatgcaggggccaaagtttagcctgaaggagagataccttcatcaataaaatcttttttgattaaattcagtcttttttcttgggtctgctcagagcttggaaaataagacgggtgtactttctaacttttatccccaatttgttccctgaggatttcaaggattctgttgccatcggggcactctgaaagaagaaaggaaggagtatgctttctttaacaagttgtctcttaacaaattcatacccaataattcaggcttggacattcactgtactcacctagcttggccaagtggctctgtattctatgttaactgtgatctataattttaaaagtagtcatgcatagcttatatagagaaccatcttttaaaaaatactctaaattttgttctaataaggagaaaagtgtatctacattgcatgtgatactgaaactagacaaattccttgtagccttttatctgacaacagctaaaaggcccaaattgaaggcaaagcaatgatgcaagtgaactatacaataagcacaattgtattcattttatttccaacattataataaggaccatatattattcactggtatatattctcttcactgtacagtgaaatatatgggaaaaaatcaagacccttctcttttaaacattagctctatatcagaaaggaaatggtctatatttattgattttctttgagggatctaggtaaatatcacagggctatgactgggtcctagtctccataccaccagtgatatggcttgtccaacatgacctttagaaagactcagagtttggctttgtgtttctcatctgtcttagtctgcttttgctgctttaacagaatacctgagactggaagatttataataaacagaaatttatttggctcatggttctggaggctgggaagtcccagatcaaggggcaagctgcatccagtgagggccttcttgctatgtcataacatggtgaaaggcatcacatagccagaagagagggtgagaagggctgagctagtgtttacaagaaacctactcccatgataacaacatcaattcattcatgacagcagggccctcataacctaatcacctcttcaagttcccatctgtcaatactgttgttctggggattacgtttctaacacataaactttggaaacacattcaaaccagagcaccatcctattctcagtaataccctttgtcttaatttttccctactaacctgggatgatattcaaagatattcaacaatgcttgggcactgaccaataaaaatgggactagacaccaggcatcaagaggcagtccagcctttctaattcatactgtctgacatccatccagtcccaattgtttcaaaggttctggtgataataggggccacctctcccaaatttgccttcttaactggattcctaaaaggacaagtcatgaatctctaatcataattctagcacacgtaccacaggccattaggaaaactatcctcagataaatgaagcctccccataccctcaaattacatcatgaaggtgagacccttagcatggtctctgactcactaggcaaccatggccaagtgatttgcattcttgagaaaaacttaccctccttataacagagaggaggatccctcaaagagatcctgaaagctcaagtaggagaagacactacaacgtggttggaatgcttcaaaagataatactttctaatcctaagacataattgctaataaatggtttcttttttacgtaaggtcaaagaatttttaataaatacagtctttggtgctcattaagaagacactaattcttcatgggttcataagcacacacataagaaaaatctgcagcaacagtacagtaataaatgtaaaatcctaatgagagaacatacattggctggaaaagggtattgttcttttcttccttcttttcttttgcgaatgatattgtaatgaattttcttcagaggacttattagtgtctgtttaatattatctctctctttcatgtgaaaactttccttagaatcttaggcaaagctttaggccttcaatgaagacgtcattaaaaaataatatctaagcagtgctcaaaatatcacattacaacaagttaacagcactgtcataggatatagagatgggatgatattaactatcagagattccagcctgatctatcagtaatttcattatttccaagtacgaaattaacttctttgagaggataaagcctgcagggctctggaggcctcttttgatctaagcagattattgccctgtggggactccatggtgggaattagatctgcgttcttggtggtgtccatagctggttctccattttctacattcctcatgttagaatggccataaatacggactgagcatcaatctgggactctttttcagattgcctagagggccaaacactggaaaagaaaagggctgcccgtgaaacttctggttcctgccttactgagggcttcaaggaaaggctgggtttagggttcctgaacactctgtgctgcctcggttcatttcctgttggggaagttctgaagttcatctgttacattcccaatgcttatgttaattcatatgcaaaatgggaacccgcttaactattgccttttattactctgaaatcagccaaaccagcttatgcatcttagcagtcttaaatcagcgtttcccaagtatgatctttgaaacactattaccaaaaagctgctcaaaagagagagagaaattataataaaaatatcatagttcaaagtactttggaaatgctgcttattatctctcttccgttagtttcacgtacaatgctaaggtcaaagaagttcttcaataaagaacagtatttaattttgcttagctgagcatttttcaatgttacttgccatagaatttccttcatttctcccccccaacactggctctcataatctgttatcattctgaagaacaaagagcacacactttgagaagagatggccctaagttaatcagcacactgcattaggtggctgctatcaattttgatttaattacacaagcatgcactcagcatttatgcaacgtaaggtcagaataagggttatgtactcctcaagggtaggttcccaaattggtgggatatgttccagcccctccaaggacttacacactttcctaagacctgaaaagctatggtttaaaaatagttgatcaatccttccagttgtccagctggggtcagttgccaactctggcgggcaaaatatcaggaaccaaggacacaaaatatgaggaaggcgtggcctcttccctcaaggaggctaccatggacaactaaccacaaaccaggaaaagcatgatatggaaaagggagtggtttattctgcatgaagggaaaaggaagattggtaaagacacaggctgctaagcggggctccagtgagaagaattcccattgctgggtagaagaggacagatgggtaagcaacctgagaaggactgaggctgcaaatgtgcagggcatggccgttctaagccagtcatccccccgacatcacagatgaaccaacaggacaaaaatttaagagttccatgatagaggaggcaaaccttagccaatttcttcacaccaggaagccactgtgcctatattctgaaccttgctgacggtaggtctggagtgggcctttgtgtctcccagcagcaggcatacataggagtcatctcttcgatgggcattcacatagggctaggtgtgcccttgctttataaaacatatgggttcttaaaaattggatattcctggatgtcttgtaagtaaaatcattttacatgaccatgaggagtgatccatttaaaggatccttgcagggaagactctggggaacaaggaatccacatgcactctgagatttctgtttagatttttcctgaagagctgcctcttaggggacttctgaatttaaagagacgttagaaagcagacatgatgaaactgcgttgtctccaaactaaaaacaaaaagatgaaagtaaacttaaaagctacagatgccattcgacaatgatttgatgtaaaataatagtccatctataactcaatttagccaagtccataccttctgagatccttgacttacctaaaggctctgtctaaatagtgaccctatatcatacaagttgaacaacaacaaaaggagaaactagcagatttttacatcatcgggagggacatagctggtcaaacaggcagtaaagtttgagcacaacaaagcgagctttgaacctcctaagcaaactgacaaattgcgctcaggagtccagttcccagcatcagcaccactttgccacaatggcttgtctcctatctctcctgcctaatggctttccatgccaaggagggcagtcagtgtgatgaaaataaccatcaacaaagcatttggtgattagtcgtctgcttttttaaatataatgcctgccagccaagattgataaattattttggtcattaacaatctatttaacaactgtaaatttaaagtgatcactttcctgaggcttagtgttatagaggttagggggtagaatctatttagccagagttaagagctggaaaattaagccagaacacgagaaacaagattacaaagtagtattcctcagtgagtgctgtgaagctatatggaatcaggctattaccaatggtgggggatatgtttaatcacctcttaaaggaaaaacaatcttaattaatgttgtatgtcataaaaatataatttagatggggatgggaaattgctaaagacgaaacccagagcaaagtgaagacttggttcaaaatgaaccacccacccatcaattataaaaatattgcccaacagcaaatcaaagaacatgctctttggtcatatttgggcagcctgaaaacactgatccttgaaaagcgttttcatactttatacaaaaaagataggaaatatttaaacttactttaaattagaattttaagtgccatatttaaaaagctgaattactcatagacacagtcaaagttaacacactatattttaaaactatatctaaaaaactcataaatatgtagtcagttgtgttggtcagtgaacaatattattatctttatgctgcaacatttggaccgaacatttcacctgactaaagtttggcattggtccacttgttttatttgatgcttataggacatccaaagggaaacatagcaaattgtttctgtagcctattcattagtagcacagagaaccaatcccagcttcaaggtgtcaactggtgttgcatcccaggccccatctaccagtagttcaataaggagcaagatggcaggaataagagggaaatgcatctcccttcagctttcaggttttagactactgtacatggctctttccaaacaagaagaaaagaatataacatgaactgattggtgcagtaaactaaactggatttatatgctctaatatggaaaaaagatccctagaactgatcctcaaaagcatctcccattaatggagaaataggagaatgtccccaagggtgaaagtctgggaccagcaatatggcaacattataagtgcgctgaacagcatttttgtaggaagtgtgttctaactgcctttgtaaaaggaaaaaggaaaataaaacaaagcagctggacaataccatttccactgattaaagttcaggggagcctgaaaagttacttatgagatatagttcaaccattttcccccttgctttcagatttacgtgatattaactcctatgcgtccacagcagccccatgatccgcctcagaggaattcagtgcctaatacttgactaggaagaaacattaggtattgatgggcaaagagttttcatctcaaatgcctctctgatcaactagcagtagctcttgttgaggagtccgaggccatatttaaactcagtggaaaacagcagcatgggaaattagcagtttggcatagagattaagaacatggattccagcagggagcagtggctcatgcctgtaaaataccagcactttgggcggccaaggcaggcagatcactttagaccagcctgggcaacatggcgaaaccctgcctctacaaaaaatagcctggtgtggtggtgcacgcctgtagtcctaattatttgggaggctgtggtaagaggatcacctcagcccagtaacgtcaaggctgcagtgagccatgatcataccactgtactccagcctgggcaacaaagtgagaccctttctcaaaaaacaaacaaacaaaatgatcatagattctaaatacatatggatgtttgaatcctggccctattccttaccagcataacaacataaccttatgaggttattatgaacattaaataaattaaggcaactttcacaatgtctagcacataatttacacttcataaacattagcatcataaccaggaggactaattgccattgttgctaattggcattgcagagtagagttgtggcttgtcttttgcccatcaggctatctgtgtttcagaatctgctcctcaactcaagtgtaaaacttacaagcagtggtggagtgggacaagtcaaatctacacagttctttatatgattgaatcagtgaactggatagactctaccaccaagatgtgatgtgttgcgatggtggttctgtagtatgtttggaccgtgaaagatcaaaaagtctttcaatgattcatattttcagggcattgcaaagtgatcaatttggtacattcttgacttaaaacaatcacttggacttctccaaacttcccagactgctaataacatgcaatcctacttctaaccaaagtgaataaagcatcaaaaggaaaccttggtttcatcccaagtgctaccagctgctttcacatattgaaagtttggctctaccactaacaggaaaggaaacactttcaaacctggcaggtgatgagaacagacttcagaacttggctacactgtcatcagacatcaggggctggaattagggcaggggttctcaactggtgacaattttgtcccacaggggacatttgacaatgtctggagacatttttggttgtcacaactgggtgggaggtgtttctggcatctagtgggtagaagcctgaatgctacaaaacatctcactatgcatactctcactccccaaactctgaatcttcgggtacaaaatgtcagtagtgccaagactgagaaatcctggattagcacggaacacagagcagtgtggactcattgctaaatgttttcctcactatactggaggctccaggtaagtaggaatcattgtatcttcagtgcctagcacagttcccagtacttagcaggggctatattaatttttgtggagtgaatgcactataatagcagatattaatgcaggtcagctaccatttttcttcacagcagagcaaatatttcttcaatattaaagtcagaaagcaaggtgaacagagaagacatatcagaacatgactttgcttatttgggcatctagcacatcagacacttccaataaatctgtcccacttccttcattccctatcttccctagagaagtaactgatgccacatccagaacctaacaataagttacgtcaacttgaccagcaccaacatatttctagaatccacttgcttctctccttccatgaagcctaagccaccatcatcaacatctctaatgagtcactttgcttttgctcttgacctctaacttccattctccacagagcaataaccatatgtcctgttaaaggcgttaatcagattacatccctcttgtgtttaaaacttgctaacatcctcacgggggcttaaaacatcttacaaagtctggcacctgctcaactctgcactacaatcatagcggtcatcttcctatttaaccaaattgtccaattcctttgcttctcagagcctctgcactggcctgggaatgctcttcatctagatccttacatggctggcactttcacataattcaggaagtggtttaaagtcaactcgtcagagaaattttttgactgcacagaatcttcacctgtgtagtcagacaagttttcttgtctttagattatgaggcacaatctgagagctttatttgctcatttacgcttgtacactggcatccctcccagactggagtgtcagcttcatgaaaacagagaacctgactgttttgttctctgctgtgtcccaagcaagcacagtgcctggcacaatgtaagaagtcaatacacatctgttgaatgaatagataactgaggaataaatcgatgaaataaacagttcatatacatgaactagtcagagaaaaaagaactcatctaaaagaaaatatgtgttaactgtcacttacaaaagagttgcctagaattttcaaattaaactccaaatagcatcctttatttaactgcgatcaattcaacataagactgaaaatcagaataatagagggtagttagtgttcatctagcaccaagagtaactcagaaattaaattaacagtttgttagtataaatctccctcgttctctttatgagtactaaattaaagttcatcctatatttttaaatctgttacaagcaaagagacaatgaaataatgaaagtataatgaaataattttactaattcttaatacataaccatagcaatgattttgtaagtttccaaatatggttcagcagtgtggaccagcatggcatgaaaataaatttaagtgtgttttccttttataatttttattactgtgaaagaaaataattaaggtatttaatattcacaagcagtatcagaggcaagaatacgagtatgacattactgacgaaatctggaacataacgcaagtgtaatgttgctttttttggaccacgtgatatatctgaatgcaacaaggaaagaagccagaaacatgttagcaacgattgggagggtgagttgatggtagcatgtagagtcaagcaaagtcagaggctgtgacaaaccatgctgaattagcacatgcagttcctcttggtctgcctcccacccacctttccaactgcagttcttatcactccaacaacatccccaaaacttgcagggttctaaagtttatatagtcttggggtatctgtgtccttatttacaccacagctgagtctaaaagaactttctgcaatgatggaaatgatctaattctgcactgtctattgcttctgtatcgagaaactgaattttgcaaagcatttaatgttaattaacttaaatttagccacaggctgccaaattgcacagcacagctctagacaccctccctatagtctgcaaactcctgctcgtccttcaagacccaattcaaatgtctcttcctccagaatccccttcctcttcctgttccctaaatagcaggtttcatggctttaatgataaccatttatcacattctattacaatcattttatggtatgttggtccttccaactacatcaagaatctctcaaggggacagactctgcctgactcatctctaaatactcagttccgtgcttggcacatgagaattatttgataaatacttgttggatgctcaagtgaaataatgaagccatctttagacatgaacaaatataagcacagcttaccagaaaagttcttcccaggggaaggtttactccatttatataagaagctgcaaaccagatatagcttgagcatccctaatctgaaaatctgaaatgctccaaatgctccaaaatctgaaactttttttttcttttttttttttgagagggaatctcaccctgttgcccaggctggagtgcagtggcgcgatctcggctcactgcaagctccgcctcccgggttcacgccattctcctgcctcagcctcccgagtagctgggactacaggcacccgccaccacgcctggctaattttttgtattttttagtagagacggggtttcgccgtgttagccaggatggtctcgatctcctgaacttgtgatctgcccgccttggcctcccaaagtgctgggattacaggcatcagccacggtgcccagcccaaaatctgaaactttttgagcaccgacatgatgccacaactggaaaattccacatgtagtgttatgatgggtcacagtaaaaatgcagttaaaactctgtttcatggacaaagttatttaaaatattacatacaattatcttcaggctatttgtacgaggtccatataagacataaacaaattttgtgtttagacttgggtcccattcccaagatatctcactatgtatacgcaaatatttcccaatccaaaaaaaatctgacaactgaaccacttctaggcccaagcatttcagataaggggcagtcaatatgtatgaccttcagatttgatagtatttcaccatatttgtatatatgtgtgcgtgtgtatgtttgtgtgtgtgtgtgtgtgtgtgtgtgtgtgtgtatttggtagacactgcttaccaatgttaaaaacagatttccaacatttcttgaaacaaatattagatctggcaattttagtcccatatttgggcttggcaacaatgaactagaatgtaacaagcagctgcatcatttagataataaatatcctctacagaatctttttttttcttctttttttggtacttttagtccactgttgtcatttatggtctctgtctttctcctgcagccatgtgaccttacaacaccagacaatgaatgaagagacagaaatttcaagttcagacattgatttctcaccgacattagtaaaataacaacagtgacaataatagctgcaaaaacaacaataataatggctggtagtatttattgaacatgacatgccaggtattatactaggcaattaatagacattgtcagatagaatcctcctccatgacctagaaaacagccttagcttcattttatcaatgaggatagtgagatgctaaggggcaagctgaaaacaaacagaaaggtcttcccctagtctgcccaccatcagagtcctcactgccatctcttcattacaaggcgacatccctcttcactcctccatgttcctcccagcctggatttagacccagagcacaagacaaagtgggaccttgggcaactgacataacctttctgcattttgctcctccactcacaatggacttcagaaataagagctgacattacctccagggtcacatgcgggcacatgagatgatgtaggtcaaacactgaacttctcagacacttttcacaaatggaaaatgatctcatctgagcaggcagagaatggctggacaaaggctgacacatctggagtagggaggcatggaaaggactgaactctcttaaggtaaataatggccttgtggcttttgctagcacccaccctcaaggagccctcatctagggagagcatgtctttgtggaactaatacaaatttggctccatgaggcttgcctagcttcgtgccagttaggtgatattgaaaggatgcaagtcaatggaaggtttaagaatcagctattgtaggccaggcgcagtggctcacacctataatcctagcagtttgggaggccgaggcggacggattgcctgagctcaggagttcgagaccagcctgggcaatatggcgaaaccccgtctgtactaaaatacaaaaaaacaaaaaaaaaattagctgggtatggcagcatacgcctgtagtcccagctactcaggaggctgaggcaggagaactgcttgaacccgggaggcggaggttgcagtgagccatgatggtgccactgcactccagcctgggtgagaaagcaagtctccttctcaaaaaacaaaaacaaaaaaaagaatcagctattgcaggcctagcactctgccaggccaggagttggcaaacgttttctataaaggtccagatactaaatattttaggctttgccggccataggtaaacaaatgagtatggccatgttccagtaaaactttacttacaaaactaggccagggcccacaggtatcgtttgcccacaacccctgtgctaggcaccatggaggcagagcagaggctcttcacagtcatccggcacaatcaccaggggcaaagcatgaagcagcctgttggattccccactctggtagccacagtcctctgaggtaaaggcctggacagcaagaatgacttaagcaacagactttcttggtggctccagccccagactcaccccacagggcatgaggagagtgagcctctctttcccatgaatggttcctcccagcagttgtgcaggcctgtccgcagaacaggtgaggctacatggccttcaaccacgtgatgtattggctcctctgactaaatcaaagtccacagatgataggcctacaatatccaagaagttgccaaacaaagatgcttaaattgatacagacaaaactaaatacctctccttcccttgtgcctgctttgactcccctagatgccatccctggtgccacttcacactgagctatctccttgcacttgaatcccccatgtctcattaccatgtgtatatcccaagacggggtggctcctgttgtaggccacatatgtttggttgttgtttgttttttttgagatggagtttcactctgttgcccaggctggagtgcagtggtgcgatctcagctcactgcaagctccgcctcccaggttgaagcaattctcctacgtcagcctcctgagtaactgtgattacaggcacccaccaccatgcttggctactttttgtatttttggtatagacggggtttcaccatgttggccaagctggtctcgaactcctgacctcaaaggacccacctgcctcagcctcccaaagttctgggattacagacgtgagccactgcgcccggccaggccacactgtttaaaatctatgcagtccttctttgatatgataaccttggggttgtttatatttcttccaagtgtatgaccaacaggatgcagagaagcaaaagttttcttactgttttgtctgttaacgtaacctcccattgtctttatgcttttgtttctgttctcatttaatcctgttttccttcacaggattaagtctgctcatttctaaactattgtctgaactttaatattctaacatgtcttagtgtcatgtttactcttcactgtttgactttctgagtgaaatagtgaagaatatgagagtggaaaaggtatttggaaagattctaggttttaaaatttcagctttagttgatccttcctacctgtgggaccttgggtaaatgagtgaataatctgaacttgaattgcttcacctgcaagacaaaggtaagtatgccaatctcgggagaggtatcatgaggattacgagttaaacatggaaaattcctcttccaactcaataataaaaacacaaaaaatccaacttatatgggcacagaatctgaatagacattcctccaaagaagctatacaaatgaccaaggggcatgtgggaagatgctcaatattagctatcagggatgcctcacccaaacaaaaggacaatgagataccacttcatgcttattgcttattcggatgactataataaaaagttacaaaataacaagtactagtgaaggtatgaagaaactagaatcttcttacactattggtaagaatgtaaaatggcaacgctgctttgaaaatggtctggaagtaccttcaaaaattaaacatagggttaccttatgacccagaaattctattcctagttatataccctagagaaatgaaaacatatatccacacaaacacttgtaatattaacagcagcattcacagaacgattattcataagaagcaaaaagtagaaacaactcaactgtctatcaaatgatgaacagataagtaaaatatggcctagccatacaatggaatattatttagcaataaaaagaagtttgtgaagagcaaagaaaacaagcaacatagtgaagagacaatttacaaaatgggagagcatatttggaaaccatatatcagacaggggattaaattccaaaatacataagaaacccattcaactcaatagtaccctcccctgtaaaataacccaattaaaaaatgagcaacggacccgcatggatatttttccgaaggggacatacaaatagccaacaggtttataaaaaatgtgaaatatcactaatcttcagggaaatggaaataaaaaccacagtgaggtatcatctcacacgtgttaggatggccattatcaaaaagtcaaaagataacaagtattgctgagggtgtgtagaaaagggaacccttcttggtagaaatgtaaacttgtacagccattatggaaaagagtacagagtttcctcaaaaattaaaaatagaataccatatgatctagtaatcccactcctggatatagaaccaaaggaactgaaatcccccatccaaaagagatatctccactcacatgttcatcgtagcattattcaaaaccaccaagacatggcatcaacctaagtatccactgacagataaatacagacatgcgatgtatatatcaataatggaatacgatttactctttaaaaagaaggaaagaaaatcctgccattcgcaaaaacatgataaaactagaagacattatgccaagtggaataagccagacacagaaagaaaactactgcatgatcttacttagatgtgtaacctaaaatattcaaactgttagaaacagagcatggaatagtagttaccaagggccaggcatgggggaaatgggaataatctggtcaagggtacaaactttcagttataagataagtaagtgctggcactctaatgtctggcatggtgactaaggctaatgataatatattgtatacttgaaatttgctgagagagtagatctttactgctctcaccatgcacacacacaaaaggtaactacgtgaggtaaaggatatgttaattagcttggttgtggtaaccatatcacaatgtatacgtatgttaaatcatcacacagtatatcttaaatatatataatttttgtgaatcataccttaatcaagctgtaaaaaaagaaatgaagtgcggatacatgccaaaagatgggtgacccttgaaaactttatggtaaatggaaaagacagtggcacacaccaccacataatgtatgatgccatttatatgaaatgtccataacaggcaaatagagacagaaagtagattagtagtttccagggttatggaaggggaggaatggggagtgacagctaataggcacagggtttcttttgggggtgatgaaattattctggaattagattgtagtgacagttacacaactctgaatatacctgaaatcactgaattgtacattttaaatgggtgaactgtatggtattttaattgtatctaaataaagctgttactatatggaaagttcttagcttcatgtctgagacaaaggaagaaataaaaatggtcactacggttatcattcattcacctgcattttaaaaatgcagtcggtttttctagagacttttcacccctgttattctgagaattaaaatactcaaacatatgtgtggtgaggtctagaagaggaggattattgtagcctggagtagttagaaaagccctcgagaagtttaaacagaataaaggaggaggcaaaggagaaatcaccaaaggcagcaatctgaaagtgaaaaggtgggaataatttggttccctgtgagagccataaggaggcaattcgattaagcaaatggctcatgaatgcaagggataagttgaagagaaggcaaagttagatttccaagggtcttggaagcataggccaagatgtttgggcttcctccagctttggaatgtcaggaactgaatttaaggaaagccatcctgccagtttatgtggtacaaaagggactggctgaaatcagaacccaggaagtatgagttagttagggcctgaagaaagataataagaatggaaataggaaagaaatagcacaaaatagtggctacttctttttttttctcccccacacccccccgcccccggacagccagttgttctaaaggggctatttctttatgataaaggtgacagaatacagaagaaaaaaaatctcccttcctccttcatcaacacctaacaaaaggaacaataataaccataaaatcatggttaaaaaaaaaaaagggaaatttaccagtaagctctaaataaggaattaagcacaaacttgtgccataaaattcaaaagaggaaactaattaaaaaaaaaaaaaggaaggcaggaaggagcgagggaaggtgaaaaagcaaataggagatgattttcatgcaatttgaagttgcatcaaaatcttccacctcaactgtcagaaacagattggagaaagtatttgagttgacaaaattatgggatttcccttcaatattccccacaatcaggagacaagtagactgaagtcatgattttgatgtaggatttttcttctcagtcactttgcaagctgggaacccctggccagtgatgcccgtaccaggccttgcttggccatgctggtgtgctccagcttcttgtgttatagcttgtacccgtgtttggtggttccctgagctcttgtaccatgcccaagaagaatgaggatacactggacattgaagggtgaggagggcagggaagaattttactgagtgacgaaaacagtttttagcgaagaggggatatggatttggtctccctacctgaaggtgagaaagttcccctgtgtggctgggcctggggccttttccagacttagaatgggaagtgcctgctgatttgtttgtgagtctgcaaataagtctaaagcaaagacaccactcaaaggtgggcacaacagtgtagaaaaccaattaggaaagcgcaggtatatgtaaaacaggtgaagggtggggaccaatcagaggagagcttaccaaacagaaagggaaattctcaatccagtctgaggatttaacttgtagcttggctttcaggctttaaactctcttccacttgaggtggggtttcactggggacccacccctatctgcctaggcatttgcctgcctcctgttgctatcaatttggaaaccttggtgaagccccagaaaaccctggggagtacaatcccagaacttcagcccagccaagaatagcaataattatgacaggggcttggcaggaaaaaagaattgatagaactagagaatgacagcatacagaggacgaacttcaagaataaactggagatgacccaaagtttctagcctggatttttcagaatgggggtgataccagtaagaccaggggtcagaataggggaacattttatggtagaagggcatgcactctgttatcagataaattaagtttgagcaactcatcccttgaattcgtatgtctgtataaacctaacctagtgcctctcacgtagtaagccttttataggtgtgtgcaggagggatgaggcatataaaatttaattaaatatgaacaaatgatggtaacaataaactcagattttaaaaaatggttttgtttcaaccactgtggagtcaatagactctatgagacttaaaaattttttaattttaagctgtctcttagatattataaagccacagtgagtcatcttgcacttaaaatccagaaaagcctataaaagaatagaaaacccgaatacgtaacttcctcctgtgacagaagaacaaaaacgtcaacgttcacagcttaaagacatttagcacctcaaaaagatgtatcataggtaagtttctatacttgaatgatattatataatcataatgcattggaaattaagtcaatttacaaaaaaaacccctcagaaatgcaaataacagtgctttgtaaaactgtatggcctgttttctggaaggtactgtgtgattctgggactggacttttcattaaaaagataagagattcaggcatcagacatgttcaattattggctccctaatgaagttcactatcctgtctaatggatctttccttttcaaaagaccccttcctccttgtgtattctggcattgcgtgtctctggcatttgctctatgagaataactggacagtacaatgctcttgaatacagagagctggagcttgaatggacaccatagccccaaggacatgaaaactattttttgattgtgtgtgtgtttataaaacttcttgcataaaatcagtctttgtaatttcctagacttcaagggcattcttttcaagttggggcttcttaatgtggcccttaaaaatcctaaaattaaatgcatttttaagctatctgtgtaaatatattaaaaatttccctcattaggaagttgccagtttatggcaaagctttcagaggagtctgtaacacaaagtggatccagaaccacagcatgtagacccctaaaaattaaaaacattgaaacctatttagcaaatctgcatgaaatgagccaaattcatactgcttctgtggagttggttcctggaaatctaggcatttagtggtggagttacagatggatctcaatggcctgcgtgattttcccagcctattgttttcgtatctgattaattattctcttaaaatttccatccataaaaaatttccaaagatattaggatctctcttcacatagtctttccttcttttgaatgatgctattgttgtcactttgaaaactgtaaatagcattcaagatgatatttaagtttgtgccaacatttagtggaaatgtctaagttttgaaatagtagggagctcacattccatctggtgtgttttcattttatctcctattctcagtgaattttaaaagtcagctgcagtgtcaataccctttctgctatgctaatgtgacctccacgtggaaatcaaaggaaaggagttctcagggcaagtgattctttctcaattgaactatttagtgtcatagaatcacaaagtatcagagctgaaagcaggcttacaggtgaccatgatgaatacctctcagtttgaagggaaactgagcctcaggcagagggaactgcccatagtctcattagccacagggacaggagttgaacctcgataggaagcctttctgatggccccatatcaggtggtcacttccttccccacacttccatggccctttatcagagaccaccatcccatgttacttagcggtttcaactttgtagcacagttactgtcactaatttcttacccatgtgtagcaggctaatatttcaaagtaatcactggtgtgccatttccttcctgaccatctcttggctaaagggaagtgcatctattgcttagcagtagtctccttcactcaccagcttagcctttaattcaaaaggcgctgccccagtgtgagagagaaatgattcatgcagggataaggacacagaagagttctaactgcccacccccagagtttaaaatagagtttcaagctggataatggacagagtcaagagagataaagcaagaaagagtgcatgtgtacatgagtgggcacgtgcatgcatgtgtgtgcatgtgtgcactggggcagggtgtgctctacccttgccttttccccaacccccaggctgaatcctgaggttgggtaatatatgagttttctatttgctactataacaaatttccacaaactcagtggcttaaaacaacacaaatgtattatcttacagcactggaggtcagatgtccaaaatgggtgtaatgggttaaaattcaggtgttggccagtctgcattcctttttggaggctctttgccttttccagcttctagaggctgcctgaattccctggcttatggctcaattccatctttaaggccattgatggccagttgaatctttctcatattgcatcactctgacactacttattttgcctctctcttccacctctgtgattatattgagtccacttggataatccaaggtcatctccttatcttaaagttggctgactagcctctaattgaatcttctactttaattctcttttaccatctaacatatttacaggttctgaaagattggtacataggcaccatttgggaggctattatttggtcttccacagctgactcactgcaagccatccctttgaatttgagactctaagagtagattgaatgtgcattcagctttttccatccagaattctggtagtacacagctttgcaaagagaataatgaaggactatagcagcaacatgaatgtctgctggaggcacctaatttcctgcaggtcttagcaaagtatgtaagaacagacaagttttttttgagcccatgagaagaactctgacaagctggcaaaggccaaagagtaagtgtccttcatgtgcttgtgacaagagactatgtcaggaccatggacacctctaggaatgtaggaggccaaaggtcaccatcctgcaaagaatgatggcattccttacgggtatcagaatggaccaaagatgcacacaaggaccaggcaaagtggattacttggacaccagaggccaaggaaacaacagccaaggacaacagaatccctgcctaccccacacgacatgttgctcattaaggccccagaatacagaatctgaattgagagattataagccagaatatgactgaatgaattacaggcctgaactgacagaaacggcactgaacttgctgagcaaaacctggcccagggctgatgagatggtttgctttcacagccagaaattcaactgaactttgggagtcaagaacatttcattttttaatagtccaactggtgactgtgaaagtaatcattgttatacttggcactcaaatgaacctcagacacagcaagagttgacttggtgattgagaagaaactggagacaagacaaaacaaatgggaatataaaactgtagactatcacatcagcacaactggctagtttatttttatttatttatattcctttttatttttttgagacagagtctcgctctgtcacccaggatggaatgcagtggcacagtctcggctcagtgcaaactccacctgccgtgttcaaacaattctcctgcctcagcctcctgagtagctggcactataggcacgcaccatcgacccagctaattttttgtatttttagtagagatgaggcttcaccatgctggccaggctgatctggaactcctgatctcatgatccgcctgccttggcctcccaaagggctgggattactcgcatgagccactgcgcccggccctactttttatttttttaggtggagtctggctctgtcacccaggctagaatgcagtggcatgatctcagctcactgcaacctcctcctctggggttcaagtgattctcctgcctcagcctcctgtgtacatgcgattatgggcacgcaccaccacacctggctaatttttgtatttttagtagagacggggtttcaccacgttggccaggctggtctcaaactcctgacctcaagtgatccgtccgcctctatcccagggagtatctttatttttttttctaacaagtcaaagagtagaaataccaaaaaagtcacctctttgggtgtttcagctacttagctagctcacacacacatgtatttcccatgaggttttgatcaaaactaaagtcaatttttttcactaggttcaccaaacaactgccagtaaatattggcttctgccaatgaatgaaaaagaacacaggatgtctgctcttaaaaagtgacccctgatgtttccttcacattatcaaattattgcatactcattatattatgtttgggaaatgcaagagaatatgaagaaaggaacaggagtgtaacattctatttgaagctacaatctctcttaatttcaaggtacatgtgcttccattccattctccatttatatgccactctttccattcaatattatatcccaatgtattttttcccagtgaatttagaaagcttattttgccaaggctgaggaggtgcacctgtgacacagcctcaggaggttctgaggacatgtgcccaaggtgatcagagcacagtttggttttatacattttagggagacatgaggcatcaatcaacatacataagatgagcaatggttcattctggaaagatgggacaacttgaagcaaaggcaagaagactctaagtggggagggagcttccagggcataggtagataggagacacatggttgcattcttctgagtttctgactagcctctccaaaggaggcaatcagatatgcatttatctcagtgagcagaggggtgacttttaatagaatgggaggcaggttgcccctaagcagctcccagcttgacttttccctgtagcttagtgatttgggggccccaagatttcctttcacatttcccccccttctctttgaaaaaatcttttggaggaagcattttagaagaaaatgagtctctggtctcaggttttgtctcatctctcatggctaggatggcttattcctagatgggtaggtcttgagttattaggtatgttcatttttagcaggttgtaagtctcatgttctataaagaaaaaatagggggaggaaggaaaaaacaacaacaacaaacaaaagaacaagcctgtaaaatccatataggccatattactctgaagtccatacatcagtaggcaggtatgaaagtggcttatgtatgtaaataggttgctgttatctttttctgaagtttccgttgtctagcttcagttcacttggctttacgaaagcacagcttagtttttggtgactccaaattaggaaagatgggaaaaaaaagaaggaaaaaaaattgaaaacattgttttgcagacttgtagcccagaaaaattagaattcattccaaaccacagaaaataataaaaacaggcaagactagaatctaacaacaggtatactacagtttttgaaatataacttttctctctccagtttcccatttttactaatgataaatcatggtaggactaatttgctttattattcttggtctgattatttgtgtacagtgttatatcattaatattattcataaaaactcatttgatggctacatagatgaatatatagtattaaatatattcctctattatttggcatttaaattgtttcccaggtttagatttttcaaattaattagatcagttgtccaagttttatagacacacactcacacacactctgatgtaaactggaaccataatgcaggtaagagcattttgaacgtagaggggatgacacagaaatgcctggtattctctgggttgggtgtagacacagttccatacatgaaggtgtgtgttgaccagcctattttggattgtctatcttggagagtactggtgggccttttaggggagcaatttatcaagctaattttcagggagattccagaaacgggtacaggggacagagctggccttggtgatttgattctggagttacccacaaagttccactgtgcctctagactaagcctcatattccagctttaaaatcccattcttttctcagcaggctttgttggtttgaaaaaataccttggcatctcaggaaggacaacaatttgaactactattgtaataactgaggtaaaagttctttctcagggggaggttttgacaggaggcaggcagtgcccaagaagtggggagacttgcagctgataaaggaaagccacggacctgaggattcggagaaccaggctttgaatgcagggggctggggaagtgccaggttcagctcaacagtcatttcttgacaacctactctattatgaagtggtattttttgggtgccgggaggcagagacgatgaagatgagtaagatgcctctggtagttcataaaggcagcagagagaaaagaacccagactctggagccagacagcctaagtatgaatctcaggtctgtttcttactctctctgtgtcctcagaaaagttttcaagtctgcctatgcctccgtttctacacatgatggagataaatgtaccttaatgcccaaatgagcacttcattgtatctactaactcatcagtatgctaatgtcattatcatatcacagtctccctccacatttgaggtatctccaactaatgaaaattttgtttccagcctctttcaaggagtccaattcagccttatcccagatcaccaatagatgaaactagcccaatgccccagggaaagaaggtaaatggtagacaccgcatgtggatggaaaataatttaggaaaacaagtgcagttgtttattccaggtcacgaaaaggaaattcagcctcagtcttcaatatcaactgatagggtcaagattaccagagaagccagctgaaatttcatatatagatttgacctaaatgtgcaatgtcctttcaataactctgaagagcttactaagagaaacaattttttagagtcgctaaaaggaaattcagcctcagtcttcatatcaactgatagggccaagattaacagagaagccagtgaaatttcatatatagatttgacctaactgtgcaatgttctttcaataactctgaagagcttactagaagaaacaattttttagagggaaaatatatgttggagcaaggttacatttccgtgcaaagggaatattctatgagttccttagttaccactaatgtaagaaggatttccagcaggtactggtgcaactggcctacaagatatttatggtccattaagagttgtaagcaagactgtttctttttcagaaaaaaagcaattttctcttaaatattttagtgtgttatgacatgaatacactatagggcaagcaaaagtatttaagtggttcagcacacaaaaccagctccaaaaggatgaccttgggaattttagaagcttggctagagcatgttgatgacttccttgtgtttaacaaaaactataaaaaggagttataataaagtacctagatggggactactgggccatatcctaaaagcagagaaaattcctgactttgtaaaatgtcatttctttcactgtaagtctaaattactggtagtgtgtctaggacttataaatttattggaaatccagtgtgtgtgttgtgtgtcgtgtgtgggtgtgtgtgtaaatgtctctaaggttgaacagggatatgaaaaccatttgggatttagtactggaagtcccagtgtctaagaaaatcgcttttctccctatacatgggttttccataaaattgaaggataatattttccttaggctaaagcaaagggtgatagaaacagggacggctttgtagtcaaacagactttgatataaacaagctttgccatgagctggttatgaggttttgacatagatatttactctctgcaaatttagtttcaattcaatggtatgaatgatatgcttggcacctagcagacagtccagcccaatgtgtattctcattgacagtaataatttgattattattctcaaatattacatttatttaaaatagatgtattactagtctcagtgtattctcaatgacaataataattgtattatattattatttttcattagtgctctccctaggagcaaagactgcgaactatagttgtttatgaccactaaccttacactagaagcccagtatgattgggtatttttcccccattttaaatatgggaaacataagatactgagatttaaatagcaagttaaacattaaacagtttgcaataaaccactatgttgactcaaggtggagagaatttagagctacacaggtataccagctatttcttgatttccttgattagaaagaaaatctggcatcattcaaattcctattctaaatctggggaaggtcataacagtctccacaaacagctgcttgccagtaagctgaagcagtttgaaagcattctagagcaaaaccatccagaagaaatctaatgcatgatacatatgttattaaaagtgtttggtagcaacaccaaaacaagtacaaagaaacaggtgaaattaattttagtgatataatttttaactcaacattaccaaaatattatttcaacatgtaactattataaaacattattaatgagatatttactttttttttggtagaaggctttgaaatccaaactggattttacatttacaacgcatctcaattcagactggtcacaggtggctagctgctaccaaattgaacattaatggtagacgtcaccccgcagtgacaaaaatataaccacatttgaacactcaagccgggattctaaacatcaggctatgtttccaggactctatgtctccaaaagcaggcaacttggaggccttaggattccttcctgctggcatgtggcacatgaatgaaccttgctccaagctaagaggttacgggatttatttatacaggttgtttgaattacgtgtatcattcttttgtctaaagaatgacaggtgataatttaaaaataaaaacatttacaaatgctttgggactttaaaattgtattaatttttatcttctgtttccccctaattcttgcttattttgattttcttcattaaaagagagataaagttaaatgtttgggggcttttcactttggggccattataatttatattgagggaatcgtgtcaatgcttaattcatatctgttttatctttacctagtttatccatttctgatcataatttatttttccaatagtctttttttttttctatccttaatccctatactctcatttctctaagtaaaatagatttggaaaaactactgaggtcttggtagtttgctttagcaggttaactccaaacttatcaaaactttttggacaattttaagtgactgtttattaatagctatgtcaagaaccttgaatgtaaacctaagatttttttaaacactgaaacagcccattattcaagcactgtagttaaacttaggtttcattgcagcagccactgtgagactgagagcagaactgtgagaagcaggtaggaagacagatggactccagcaacaaggacacctcggaggaggcattttcctccttcaccggcaagcaccttagagctttctgatggaatgtatctggttggagcgagaattcactgtggagggcagataggactctgcacaagaaagcctgattcgtgaaataatgagagaggaccacatggagtggtttgatagagtggatttactatggatgctatggatagagtgacacgtgattaaatttttcttatttctcactaacatgcgattgaacgtattcaaacaacataggagagcaattttgggaaactaatctagggtggcttacctcaaagcaaactctaggaaaaagccatggcatcctttgccttgaagctcaacctgtagatacctgcatcctcctcatcaagcactcttcagccttctttcattacttttcctctttagtgtccaatgacttcatgatcttccttggaggctccagctcaccatcactaccattatagccctccatgcttctcaacattcctcatttgctcagctctagcctgggctgggcacagtggctcatgcctataatcccagtactttgggaggccaagccaggaggattgcttgaggctaggagtttgagaccagcctggacaacattgcgagacctgtctctacaaaagcattagccaggtgtggtggtatgtgcctgtagtcctagccactcaggaggctgaggcaggaggatcacttgagacccggggtttgaggctgtagtgagctatgattgggccactgctggccagcctgggcaacaaagtgagaccctgtctcttagggaaaaaaaaaaaaaagagttaataaaatgactaacctgaatcatatattgtgacagttaatattgagtgtcaacttgattggactgaaggatgcaaagtattgttactgggtgtgtctatgaggatattgccaaaggagattaacatttgagtcagtggactgggagaggcagacccaccctcaatcttggtgggcaccatctaatcagccgtcagcatggctagaataaagcaggcagaaagtggaaagagctgacttgctgagttttccggccttcatctttcccctgtgctggattcttcctgccctcgaacatcggactccaagtttttcagcttatggtctcttggacttataccagtggtttgccaggggctctcgggccttcagcaacagactgaaggctgcaccgtcagcttccctacttttgagattttgggactcggactggcttccttgctcctccgcttgcagatggcctattgtggggcttcaccttgtgatcatgtaagtcaatactccttaataaactctccttcatatatacatctatcctactagttctgtcctgctagagaacactaatacatatattatctgaatatttgtttctgtgagaaaaatgggcacaaataacttttaaccagataaatgcttttctgctaattttgtgtctctcttttgaggaacatagagatttagctcagtaataatctgacataggatagggtaaaccagatgcttacccagctttctcattactaaaataggtagtcaaagagcattcatagatacagagggagcatttgaggtcataggtcattaaattagcattactatatgcttatttgttagttttatcacatctggttctttgaataaaaagtctccattaatttagaagaacatatcaagttgttatcttattctgagtgagagacaccaaagttttcattccaaaattctgaaatacccagaaacttaccactcagtgggaggacatcagtaaacccagaagacaaaaagctaattaactgtctcactgaaacattccttcctttttgaaaagtcaactagggacccatggactctgagcccattgtcaaatgccgtgtgaaagagatccaagttcaacaacaaatatcatcagcaatataatggttctctccagccctcagggccaaatggcctgcattttagcaagttgattttgctcatgaattgtgttaagccaagcaattgtttcccatgacatgcttgaacccacagttgctttgtctatgaaattcatggttgaatttgtccaattgctgattgctattcccacttgctttagtaatagtcacttccttcatcagtaatgggttttatatacagtgcacagtcacaaccattcaatgtcacccataagcatttgatgaattgtccaatacagttatgagagttggttatttgggatacagctagggtaagtcttactgagttaatgaaatgatatgacattaggccatgggtgtttcctcccccacattggctatacacactcttttatctaaggacgcatttgggtcattaccataatcttcatcaacttgtcaagataatgaagggcccattgagttcagggaaggcttggcataattcatgaaaatttaaagaacatagatgtagaaagagtttgggagctacagataaataagatctgcatagacaaccacaaaggaagagcttcagcagacaatctgctttggaagggggagagtttgagctcagttttgagacagaagagaggctcatactctgaaatgtctaagacatactgctggaggaacagaaggtgaaaacaaacttagagatgataatcaagattggaaagaaaggaagagtagctctcgagcctgctttcagcaaatcctacatctgtatttgttatagccaccacacaaatctaggtttggtgggagggggcaagttagttatcaacttcgacatgtgcctatcagacttgcttagcaatcagacaaggtttataattgcttccgctaacctttccagagtaccacaatttgtagccttctgcacactgatttctgaccaaaggattctgttccatcaatgccccattaaattcacctcagatggctgatggcaccatgtcgaagtctcacccagtgtggctatgagttagtgaattgaccgtctgaagagcaatatatagtctccttttaaattatgttagaactagcagagaatttcaggttcttctagttcaacaccttgtttttttttaaatgtgttcattcattttcaaatattcactgaaggtccaccctaggccagattagatccctgccctaaagactgtaacacataattgggggatgcaggtattgaataataaagtaataaattatgtcaagtgtgggaggtgttaagaaggaaataggtatggcgatatagtagagttactctagaggggacagaggattaactattacagatgaaatcagagaacagtgaaaaggaccctttgaggaggttctgcacatgtatcccagaacttgaagttaaaaaacaaaaaaaactcacctggggccagagcactgtaaatgaataggcagggagattaaacagatgtttcagttaaacagcatgcccagtataccagacagaagatcctggggaatagtaatctttgagtagcagagagaagaggagcagcccatgaaataggcaaggatcttaaactccaatgccttcaggagctatgcatgcaccattagccagtgaagcaagcctaggtagaaggcagtcgtggcaactgtataggcctagagaatgagcaatatgcctaacagcattcaaactcattaaaaaatactttacagtcacaataaagcaaatcaccaaaaatactttgcaggcaaaaataaaacacatgtgaagaggcaagcaaagcccaaggaccatcaatatgcaatgctgagctgcaggaaaagcaggaagtaggctgggaatgagaaaaaaataaatacagtgtggtttcctctaagttaaaaagaaaaggttttaccttttatttccatgaacttaacaatgaaaacaatatgtttcactaggcagtcacccaaacattgcaatactgatcacaaaaaaccccccactatttgttacagaacttgtaaaacctgaaaatggcggtaatgatcaaatgggtcaaatgtgtaaagagaggcaccacaaatccaagtggcccatgcactgaccaaatgtagatatcctcttgaagaattgtggccatgtgctctgtgcttgagtgaatccagggatgggaagctcacccccttggaaggcactctttaagtgttcattttttttcactttgacccgttattatggagagctaatgatatctgccactttgtagtccgatactcacagatctgccctctggagccacatagaatgtatttaatatctttccacctgccagcccttcagatatttggaaacagtgactctgttactatcttccctctacaagtcttcctttttccaggcaaaacattcccaccatcaattagtctccaaatctgttttcagacccaaccacctttcttatgaaccttcttatttgtcactaaccatcttaaaacagtgcctagaaagaacacaatgttcctagccaatttatactctggggcttctttaggcataattttctatgtctgcagcagtagaaatacaattacattttatggagctcagtctcctgctgttcctgtttcctacctcccaccctccaaggcagtctgtttgttgaatgtcctgaacagatgcataatctagagcaagtgctcccatcaatataaagaatgccatccctcatcactccatcgcttctgattaagatcatttggtctaatgtacattaagttctattccaataatgcctgtgcggtactgcatgcttttcatgcctctttctggacactgtgttattagatactcagcctggagaaacatttccatacaaagaggaagataaaactgagaatgaatggttaaaggcaaagagaaaattgggaatctcacccttggaaagaatggtagatgggaacatccaatgacctggctttgaatctggttctctatttactaaccattgctacttaaagaaaaatagtaataataacagtaagaacagaaactactatctattaacaaattcttggtaagtaccaagccctgaaataagcctttcaggctacaatatcatatggttagtagatgccactgggatttgaacttacttctgcctgtttctagacttcaatctctacatagtcttgtaccacaatttcccttagtggatactgtctatactacatatgacttataccactgatttttaaaaaaagaaaaactctcacagtaattacttctcctgagatgatcctccaaaatgtgggaagtagaaacatgtgttttcttttctgtggggccatcagagcatgcagacaagggcaaaggaataagacaggagagagaggccatacaccaaccacagcactgtacattgtgtcttgaactgggctgaaaagtaaccatgcagcttcattttaagcacagttggaacatcgacaagatttcaaggtgactgttcagcctaaggaaacagtgttttcaagcacttttatgctactttagcagtatttactagtatataattcacgtgctaatttattcattaaaacagtcgtatttggcaacattaaccttagtttacattagtgagattggtatttgtattttaattacatctctttataattactctataattctgattttcttccaatgtgaactaagcccttatcaatccccaaactgcattccacatccaacgaaaatgagttcaaattatagttttacagaaaatggctttgtaaaacccagagagcctattcccaaaggtagtcatgcatcagagtctcctggggatttccttatacaatgactgattcctgagtgctgtgcaatctacttgatcagaatctccagcgacgggacctcctgggaattgagacctgcagcaactggtccacaaatcagcacttagggactggtgactagactatttccactctacacacatccagtacagctcttggaaaacatacaaagcaaaagatagtaagggttatcctaaaggcagaataaccagccacctcacggaatccaatgtgttccagaaacattaattatacgtttcattattaactgctgacctattgttctttattttcagggtttgagttgctgttttaatttcatcactgcaaagaagccctatagacacacacacacaaaaagatgcatagattttaactggtccctggaaacaaggtagagataatcatgtggtttatttgatagagccacatgataaacaatcgagataaacaatgtgttttaaaaagcattctcaaagagttagaacaggaatgtcaaaaagacggcaaatatgatacctacctcctatccaatgcccttggcaggcgttgctaatcaatcacagcatttttccttgcatccacaaacagcctcaaagtccatttaaccaatcactccagggcactagtgctatctaatctgctctaccgtgtgggggacatactttctcctctttggctacaataaacaggtaaattgaaatcaccttataacagcctgatccatgacaggctgtatgctccacaaggtggaaatgggcatctgaaagttctcatgtagacagggctttaggcgcagatcacctggctcttgctggttcatgtttgtagtggtttcacacttgtatctttgaatgggagtacttagaaataaattaactgctttaatatttatgatatgtgagttacacttactcaaaccaacctagtttttgctcatgataatttacagtttcactttgaataaatgctgttgggaaagacaagctgagttccaaagtgttttaaaaattaagtgtagcatttgactaaaagaatcatatatcaatctgcttgatttccagtggtagcactgtaggttttcttctatggagattctgggccatatctccatgcaaatatttactgtcctggtaaatgacaggatagaaatcacaaggacacttggtttctgctggttttcatttgaaaaagaaaatcattataattaattagtcatgggttcccacgatggccattcttgactccttggcctctattgccactttccaagtctggctaaatagaattccatttcagaccatatctagggtaatacttgattcattaggttgatgtcatcccaccgacagtccccgtgatcaaacaataagatcagagagaacagacccacctcctcatagatgctgtcattcctgtgaaagtctccagccttcctgggaagaacatggacgtgaacgtgctgaaaatgtacaagaaagaaaaaaaatgtgattatctccccatgtatttttagacttgacagtgatgctctcatgaagcccaattactccacgatggttcctgctgggttatttttcagaggaagttgatatccaccttcggtaactatacctgaaatctgccgagaagagagtgcactaagcaagagagaacaacttggggtatatatgagagttggtgcgaaatgctagagtgtttcagagtctctgtggaattattcatggttgtcagtcttggttgtagttagccagtgctttgaaatgacagtgcatcttcaaaggtgaccatcatgactctgaaactgacaagaaataagaattggctaacagagaactgcataagtaaagagcgagtgaatgaggtagcaagtagtatgggcagaattacagacttggggcttcgaaaaataatcatataatagtaatacaaacagttctcatttagtaagcatttatttcctatgataaggaaagctctgtgtttggcattcttcatttagtactcttaaaaatcctatgaggtggccgggcacggtggctcatgcctgtaatcccagcactttgggaggccgaggtgggcggatcacgaggtcaggagatcgagatcatcctggccaacacggtgaaactccgtctctactaaaactacaaaaacaaaaacttaggaggctgaggtgggagaatggcctgaaaccaggaggcggagcttgcagtgagctgagatcgcgccactgcactccagcctgggcgacagagcgagactcctcaaaaaaaaaaaaaaaaaaaaaaaaaaaaaaatcccgtgaggcaaggtctactatgatctccactttacagaagaagatatcaatgttcggtgaggacagggcgccacaggaagtaaaagtcagcaccggaaatgaggttgcctggctttggctcctgtgtttcattagcacatgcactgattctgcgaacttaatcttttaaatagcccatttctctagtctactaaagcacccaggtaatatacatagcaatgctattatgcaatgatggtgaatcagggctcagagcatatctaattcaatatattcttcaaagctaaactgctatttgaaagttttactttccaaatagcctctattgtacctcggctgaagttaaacctcatttctgcccttgagctatgttccacttttattacaaaccgtggggaggaatgcgaaaatgaagagcttaaatagagagaggcagacagagggtcaaacctcatccctgatcacccaccccttcctgattactgcgatcgggttccgaggctccaaaaggcctcaagagaacgtaagatttaagtgtccctgtggcttcgctgtacaaggagggggaaagtgacacgctattaaagccgaggcagggtgcaacgtggtccaaggtgaatgaagcagagaggagcttcaaagcagcccctgagcacagttcccaaagagtgacacgcttttgccagaatattcgccagtcaatgataaagccagtcacggatctctcagcaattgggccaagtgtgcacttcagtcacaaagattacgtgagcatggagagagaaagtgaaagaacaaacaaggaaaaaataaatcacaaactacccatgaaaccaaattcttaggagaaagccaggcaggtgggcctgggctgaaatctactgaaatctccagatgggctgacttaaaagcaaaaccaggaaaataacgtagaacaaggatacagacaacccttagaaggagccttcactcactctttaattccagaatctcctgccatcctttcttcttctcctctttttgtcctttcttctttctgtccccctcctcctttcttcccctcttcctccctcccatccatccatctttcatcatctcccttatacattctaggaagttccagaccagtgtcttccagtcaaacttcctaacacaaatcctggacctaccacaaactaactgtgtgaccttgtctcacaaagtctatgtgtcagtatcttatctatatggggattataatggttgctacctcacagggttgttaagaggattaagtctgctaaccatgtgctgagcattcagctttgcatgtagttagtactcattacctagaactgtacaagaattagttttattatttaaaaaaacaaatttaaacctgaagatcaagtagacatcacattcagggattgatttctgcaccagcaaaaaaataaaataaagatattaagaagctccttgaatgagggcattgttcaagcatctcttttgtgaaagctgatttctgttgctttgactagccattctcaatcttccacctgtacttggggcttattaaaatgcagactgcagggccctaaaagtctgcatttctaacaagctcccagctgatgctggtctaatgccacactttgagaaccactggcttacaatatccacctggtttcttaccttgcttctgccagtgtgggcacggaggtcacttgctgttttgcctgccctactgcattatgtgtagactctttgtctcttttcttgttttttcctcttttttttccttctttccttctatcttttctcttttttcttttccttcttctttccctccttcctatttttttcccttcctttccttcttttctctctccccacagaatctcactctgtcacccaggttggagtacagtgatacaatcatagctcactgcagccttcaactcccaggctcaagagatcctcctgcctcagcctcccaaatggctgggactacaggtgcatgctaccacatcaagctaactttttttcatatttttagcaatggagttctcactatgttgcccagtctggtctcaaactcctggcctcaagcaatcccctctcctcagcctcccaagtagctgagattataggtgtgagctactatgtccagtatgtggagacatctttctgaatgcttctctggctttctgcactctgaccactctccttgcgtggtcctcaggaatatgcctgttagtatccactactaacatatggggggttgcgaacctgcacttgggaacctccagggtccaggtctatcccctgcctactattctttaccctcgtcttctcgatttagttcagggctatctctataggctgtgttaccactaagttctagaaaagccactcttgatcactggtaaccacttgaaattcgccgtgacacactgaaaccgtaaatagctcactgtacaggtggttttttcccgagggcatagatctcaacccaccctgatatcgtgacataaattcttaagtgacaggctgatcacacgatgctgacaacccactcagcttctcagaacagggaaatcacgatagagccagctcaaagcctcattgctgtgaaaaaataccatcactatggacttctaatagaatgacattctgataaaaacgctatgaatagcagagatgaggataatttgatataatctgttcttactgctttcatattaagctgtggtgatcacaacttacttttctaagtgccaacaaaacatctatttaataaaagccttccacaaatttgctaggggttgcagttgagctgcttgagctagaagagtatctttttaaagtcccatgacacattccacaccaaaaatgttttcatggtcaaataacatttcacaatgctcattagcacattaaagtatgagaatttccacacaaaagatgcttgtttaacttcatctaatccagcattccagaaacttatttgattgtggagtcctgattttcctgtttcattcatgtaacacttctgtacacttttctaaagtatacattgattcactcaaaaatatctatttctaggtgctattctaggagccagggatacggtaatggacaagacaaagcctctgtccccatagagcttatattccaatgggtgatgcagaagataagtaaggaaatgactatacattctaattttggatagaaataagtgtcctgaagaaaaacataacggtataaggtaaatactgagcactgggccactctaacgtttgaagtttgggaagagaagcaggactcaatttaaggctgtagtaaggaaaggggcaaaatcaagagagggtaagttccaacagcccagagaacaaatttcaaagagtgtatcactaacggtgtgaaatgtttttgaaagcttgaattgtttcagtaaggctaggagaacaaaatttaaaaccccatgaaaagatgctccacattattagtcattagggaaatgcaaatcaaaaccacactgagctactacttcatacccactagaaaggcaataatcaaaagacacacaataacaagcgttggccagagtgtggagagctggaaccctcctacactactggggatgtaaaatcacacagttactttggaaaacagtttggcagttcctcaaaaagttgaacatggagttaccttgtgactcagaattctgatcctaatacatacccaagacaactgaagacatatgtccacacaaaaacttgtacgcaaatgtttacagcaacattattcacaatcaccaaaaagtataaaaaactcaaatgactatcaactgatcaatggtaaacaaagtgcagtatatgaagacaataggatatgatttggccataaaaaggagtgatgtgcgctgagtgaaagcatcatgctcagggaaataagccagacaaaaacggccacatattgtaccatgccatttacatgaaaaagccaaatgaggctgattcatagagaaagaaagatttgcggttgtgaagagggatgcagggtaactgctaatgggcacagggtttcttttgggttaatggatatgttctggaattatatagcagtgatggttgcacaactttgtgacaatactaaaagaatgaactgtatattttaatagggtttcttttatattatgtgaattatatctcaataaagctattacttaaaaaaaaaaaaaaaaactgaaggccgggtgctgtggttcacgcctgtaatcccagcactttgggaggccgaggcgggcggatcacgaggtcaggagttcgagaccagtctgaccaacattgtgaaaccccgtctctactaaaaatacacaaaaagttagccaggcgtggtggcacatgcctgtaatcccaggtactcgggaggctgatgtaggagaatcgcttgaacccgggaggcggaggttgccgtgagccgagatcgtgccactgcactccagcctgggtgacagagcaagactctgtctcaaaacaacaacaacaacaacaaaaacccaaaacttaactgcagtgggtttcagagcaagcaggaggtgaaatagagacagcatgcaatgccatcatttttagaggctctgcctcttctgcgctgtctctgctccttccaccatctctttgaacacatctcttctgcccatactcacctgaggattgccagtgtggttgtatcgatatcctttttccttgtcagaatatattgtaattcaattctaagggatagaaacatggctcatggcgggggaaagagcaaggaaggctgaagagctaccctgctccacagctggtgtcctgcaacctccaccagttggccctgtgtgaatccttctccctcacatgtgccaatgagcaactgcagaaggcaggtctgattctaaagaacaacagacgatactgtggtaaaacgataatggccaccttcaaagttatccatgacctaatccctgacctgtgattatgttaagttacaaaagataaattatggctgcaaatgaattaaggttattaagcagctgaccttaagattggcagaggtatcatagattttccaggttgccccaatgtcatcaggagtccttaaaactggaagagggtgaacatcatcaaaattgtaaactttctacttcaaaggccacaagcaagaatgtgaaaagccaagccagagactggcagaaaggatttgcaaatcacctatctgataagggaagtatatctaaaatacataaagaactacttacaactaagtaataaaaagacaaaaatcctaagtaaaatgggcaaaggatatgaatagacatttctccaaagaggatggataaatgaatacatgaaaagatgctcaacatccttagcccaaaaccacaaagacaataccacttaacacatactagggcaactgtaataaaaaggacagataggccgggtgcggcggctcacgcctgtaatcccagcactttgggaggccaaggcgggtggatcacaaggtcaggagttcgagaccagcctggccaatatagtgaaaccccgtctctactaaaaatacaaaaattagccaggcatggtggcacacacctgtaatcccagctactcaggaggctgaggtaggagaatctcttaaacctgggaggtggaagttgcagtgagccgagattgcaccactgcactccagcctgggcgacagagtgagacttcatctcaaaaaaaaaaaaaaaaaaaaaaaaaaggacagataataacaaatgctggcaaggaagtggagaaattggaacccttgtacaagctggtgcagatgtaaaatggtacggctgctttagaaaagtttctgcagttccccaaaaggttaacaataatgttaccatatgacccatgcactgtttccagcaatttgttatagcaacaagtagagaatgaatacagatgccttgatatttttaatgcatagtttacacatttttcttatctctacaacacctgtatgaagtattattctaccaattttataggtaaggaagagacaaaattttccctcagcaagactcagaaatcttcacgtattgtttttttggtttttttttttttttttttttttttgagacagggtctcactctgtcacccaggctggagtgcagtggcacgatctcggctcactgcaacctctgcctcccaagttcaagcgattctcctgactcagcctcctgagtagctgggactacaggagcacgccactatgcccggctaatttttttttgcatttttagtacagacggggttccaccatgttggccaggctggtctcaaactcccaacctcaggtgatcatgcccagcatctattgttctatgtttgtataatcaccaacagctctcaacttggaataaccaaatgtaatgtaacaataagattgtttccatttgctgaatatcaacatcaaaaacttacagcatagaaaatctggaagagacagaaaaacacataggagaaaatttagatcaccagttaatctcactaccaagcaataacaatccttttcttcatgtagagtgatacaaatatgatacacgctttttttttttttttagtctcaattgccccagacaaaaaccctgaagcaaggatgagagtgcaagtagtttatttggtggatgatccctggaaacacgagtaagggaaggaaacaagaaaggaaaggaggccaatataggatgtgtgatcaagtgagttattatttcatgtgactggagcttataaaacctgctagagaactctgagaaccagtgaagaatatgcatcccagagttatcccagccaaggtgtgagggaactagcgtattcatacaccaacttttgtcctcactggttgagaactgctcctggggagacatcaatactccagcacttctgccttctcccacctggagagtgagaaaagccaggtttccagggccagtcagatgcaagtcaggctaggtaggatgcattgcagccatggtgggtgggggtaacacaatgtgggcagagcacagaccccacttgtagcaatgctttgcacagtgctgtctcatttctgacacctggagtctcataatttgctgctgaaccgaaagttcaagtatttagtctccttttcatgggtgagataccagacagataaagatctggttagaggttcttaaactgcaaatcccaaagccctagagcttccagaacaagcctggtatggccaaggagcagctcatgatggaagtaagaatggggcaccagaaagggcggcaggcttcagttccccctccgtgattcaaacagagcagctctgttttatctgtttctatgttgggatcccatgcacgatttcatttgcaaaaagaatttattactaaaacaaacaaacagaaaatctttgaaaactactaggattagaattaggaaacgttggggggtggtaagagtgattaatttcttcatttcacagaagaggagagtggcttttagaagaccaataacaaagcaatggcagggctgggactggaaccttgagaaccccgaaaccctgacttgtgttccagtgctttctacctcatcttgcccaacctacctttcccagatctcagaaaggtagaagcccctacaattaagcagtttggtgttcagtcactggagatgggtggccaaggttcagatcctacctattcttttgactgagtcaattccttaacttctttcatattccctcatttatcaagtgggcataaaaccagtatcccaacgcataagacttttataccgattatgtgaaatacataggtaaagtgcttaagctaatgctgcacattctgaatattcagtcaattccagcagtgactatattacaggacattagttttaaaaataattttgacaacctgcttctgttctaaaccagaaggcttaattctacggtgagccttgctgaatgtattctacttcatccagaccatcaccaaccccaaagctgtgtgttctacatggctggatttcgcctttcttgatttggggaggcctcatcttctgcaactaagtcgagtcaagggtcagcatgaaattactgacagccacttagttctaaaataaatgtcactggaagtaatgccacttacaggactttgaggatacctcagcatgatcaactcaagaatcaaattagtggcctgtcaaaatgcacaggcacactgatggtttctgatgctactgtcaatgagctccttcacttagaatattagcaatgctcaggcagttggtatgcctttcaggaaacagaggaaacatagtgcttttcatgtgttcaaagtgtcccaatcaagttgggaaacttcgaggaaaaaaataaaataaaaaaaaattcagtttaaacaaaaaaaataaacagaaaacacctcctagaatttgtggagactctgttgagtttcgtggcttaacaattgtgtttttaagccatacatcactggtggtgctccaattgtgagttataataatatatcataagagggatggtgatctcctgatatatgggtgccatacatcatctaagcaccatggctttgatgatgtattgctccaagccacaatgagagtttaaaggagcttttagcagccagacagctttaaatttcaaattttcaaaaattaagatcttttcaagtaaaaaaaaagcaagataatggaatgtgatgctatataaagtgtcactgaactctgagagcctgggtatatgccttttccttttggctttgagctcacaaggtggaaatcattggcaagttcttcttcaattcctcctccatgagcacagaggtgagcaagtgtcaatgcatccattttgccaatcaatttcccccatcttccacactgcaagcctgagtagctcatcatcatcccaaagactggatcacataaaatgctgtgataggcactggataaacccaggagaagttattttttattttttattttttggtttgttttaaagagctcttccactgagattcagaacaaaaagaacagataaaaagtagatagacttccttcctcattgctctcaaactcaaaacagggcatgtaggaagaaaacatgccttgtctagcatttgtctttgtaaagcaaaggaagcattgattgcagatgaggagaaagaggggaatggcatatgggcttctcatccagactaggaaagggagctgttgtcatagttctgtcacctttcctattttaacgatgggtttataagacggtaatgtggcttaagagaatgtacccacttcgtttaaaagccactcacttttgggggcaaagtaatcacaatcaattaagaaaacaggtgttgagagaactcctccctttttttttaaatcctactgcaataaacagaacaaaatgagaaatcttcctactgtttctgtaatagacctaaacaggaacagtgagagacgattacacttcaagtggcttcttccattttcctttactaagtgaattaaaggaaagaataagagtagttactgccatgtggagggaaacatctgggcataaggaattaacagtcttccctcccattctcctatctctaattttttgctccttgggcttcctccagtagattctaagtcccaaattactgtagatattttgcacccggctccctccttgaccacttccaaagggcaaaaacatcttatttccaccaaagaaaaccaatggctgtctcaaaaagaagtcccaggcttcttttctcctgtagtagtaagttaactatataatctgggtaacaaagacatggaaataaatgcatcacccactattctgaggctgtcagttgaaagatgtgaatgaggcaggctttgcatctagagaaatgtgggttctttcacgggctggtaaataaatcccccaaattcagtcctcttcttctctataaagagaatactgacacaacacttaattatttctttcacataagccaaaaagctttacttacgtatttatagtaatagcacaccattcatccacccaccatttttaagtcattatcagttataaaacttgctgccatttacataagaatattatatgttggaatggtacttagtactgtatattatcacatcctcaccaaaacactaaaaaatagaaactgttgtctccttttttttcagtaagcacactgatgcttactggaattaaataaattgtgcaagctcaccaagctggcaaaagtggccgagttaagattctaagtcaggttgataggatgtcaagcgtaatctgtattttgctatgctccttcctgagtaaataactaatgtctgggtgaccatatgccccagtctgtttggaaccatccagctttaggcctgcaggtatgaacaggccagtgtaataacaaacagcatcttctttcactctcctaagttctgctgtggacaataaattatatggtctccctaactagtagtatagttcatgccaggaaattttatttctgctcattctaactattctcatctgcagatagcaggggaaaaacaaagaagaaaggaaagaaagaaggctctgtgaaagtttttaaagaatgggctactaactcttatctatcaatacctttcatgaaacctccaacatgttcagagtagagctctgggagggaaaagaaatactttagactaaaacagggcccctcaagctctaaagaaaaaacctcaagcatgctagaaacctctccagttgagcattctttacttattatcatcacaagaggcaacggtaatagctgttgctatttattaagctcttactatatgccaggcaccatatgccaggaactgagctaagcactttctttgtaagatctcaattatttatcataaaactgcatgatagatataatccaaattattatcatcattaatttatagatgaagaaactaaggccgaggaacgtggaatgaggaggtctgcccgattccaacatccaagtgtgatactactatcaacactctggtacagttgaacacagcctagtaaaagttctaagcccactgcccctgcaccccctgctattcaaccttatgacagtaagctcttctgcaagaggggcccattagagagaatggacttctaacaaattgagatcaatcttgtacaaatattctgtattatcttttggcttctgattggttttcagtgacataacagctttaaattcttaaagctatttaatgagaagagagtagatgtattagtctgttctcacactgctaataaagacatacctgagactgggtgatttataaaggaaagaggtttaattgactcacagttccacctggctagggaggcctcaggaaacttacaatcatggcagaaggggaagcaaacatatccttcttcacatgggggcagcaaggagaagaatgagtgcccagtgaaggggaatccccttataaaactatcagatctcatgagaactaactcagtatcatgagaacacgatgggggaaactgcccccatgattcaattttctccacctggtcccacccatgacacatggggattatgggaactacaattcaagatgagatttgggtgcggatgcagccaaaccatgtcagtagaatttataatcactgcctctagagaagttgacaaacctaaccaacagctataaaaccaggataactccagatgtagggctctcagatgaggtcatctctactgccttgggttatggacaggtagaaccctgggaagaccattccaagatagagtcttcctgttcagttagacatgcaggagctcagaggttcttgtaaaattggttctgcttgctgctgggtgggaagggacagtgccttagtaatgtctccatctgaaaacgtatgaaagtttcaaaatgacttttaggagatacagaggatgtttcaagatttgtcacccttgtgcttctcagctgttgttgtagtcatggagtttatagtacatgtgcttggtagaaaaaattataagtgttcttccttccatgtggagttcctttctctttccttttcttcctctgagttttaaagagcatgctcaaatgccacctcctttgtgtactcttcagactctttcaggcttttctgattcattatacatatgtccatgacagctttttaccacaaagtataagtaattacaggttttctcttccactagtctggaactctgggctatttattacttatttttcccctgattatttcttttccctaaccctaggttcctaggttagaagacatattttctaaatgttgaatggatggatgaatggatggatgggtggggtggatgggtgatggatgggtgaatggatgggtggatggatgaatagatggatgagtgggtgggtggatgggtgggtagctaggtacatgagtgggaatgtggacagataggtgcatggatggatgaatggatggttaaaaaatagacaactacactgctcttaatttcttagcttgcttaaaagaagaaatatatgcactgattttcttcgccattcttgtcattttcttttgcttgaaagttcttgtgcatacaaagatatggtctatgaagagccattatgatcacattgtacacacctttcttccccactgaaaagtatctttttaccaaaatgtaagtttgaagttcttgtgtttctagcctcacataaatcccttttaaaaaactcctcagatatgctcaagtgtctggagaaatagcttatcctaaaaacagtcagcattgcaagggttgccaaggggatatatttgttcttcagtattaacttcattaagagctactgtggttctctctcaggagagaagaagaaacctaacctttctttggatatcttctgatctttacaaattatttccagggtgctgtctttgttagacaaaatatgaagaatatctatttttttatttatacatcatatcagaacattaatttgtagagtgattccctctgggtgcctttctgttgggtacacaaaaaaggatttggatgcaaatgaaacaatgatagcatttttccttgtcttactcattttgtgacaaatgcacattgctttactgtttgctatacacataattacagttctttaatttatgtttcaataaaatgtataataataaacatttactgctccatgaataaacattcgagtgaagcctctaatggaggttacatgtttcgaggcagctctgtggctttttcagaaatctgccttctacttaatgagcatcatttccataatctgtgcattattgcttaagcctccctttaaaacatttcaaaatgcaaaaatttgtgaaatatgatcagtccaaaggggaaaaaatgttaagggaattagcaacttgtcctgttaaagggacaggacaagctttcatgtccctccagagacagtaacatagtaattatggagacagcacttcctaattatctcactagctgagcgcaatactactgtggtttttgcctctaagatctggtttaaataaaagtgataagaaacctggagaggtcagccatgaaggacaagcttgtgctaattctctttccagtgctaacaaagaaaccagaaagtagaaccagaaatttggggaaggtcaagatacctgtggtatggacattcctggatgtagagacagacaaatggtttgattaaaacggtcaccccaaagtaactgaattcagacaaaagcctatgctgagctttatgtcgatggtgtcacacattattttcagtgtgttatttcttaggaaaattacttacataattttatgtcattatcactttaaaaggttaatctatttcagataatctttgcaaattgtgttctaaaaagcaggtgcttttaaaaataactaaaacatgatgacatatttcttttttctttgtccaacagccatggctgggttgtttaactagagagaaaaaaagatgccaggagaaatgaaggaacaaaggacccttcacagtgtgataagatacagatagtcagcctctgcagagcggtgatgaaatgtgttaaaagtgatggctgtcacttcatgacatgtcagcgtgctttattggtgggttggcacaatttatttaaacatcgtcaggagggactcattttggtgtagttagaagttgtgtttctttagtgtgaataaatatctctgggcccacgtgcaacattttaaaactgtgctgttgtttactgtgggaattggagcaaggagctaagagttccaaagtgaagctctccttctcccaccattttatgatttgctataagtaatttgctccttgctttgaccgttactacaaaatctttcaaaggaacattattctccttaacaggggctaaatttaagatttttcatcattcaatattgctattttcacatgtgacttcaacaaaataaaacattcggcataaatagaatttagtgtaatccaaatcctgcttttctcttggtacatatgctttgttgcttcttgacattcctgaattacaaagtattaagcagaatcatctttttaagggttacattttccttctaactcaagtgagcaggtatttacgtcaaagtcacacatttaaaaatgacatcctcttccagcatggggcaaatctcaacctacagggctgccaagtggagctgcaactttttgcaagggttctacccagatgtgctacaagtccatattacctttgaaatcaccatcttgtaaagatatctgcaccctcatgtccactgcagcattatctatagtagtgaagatatacaaacaatgtaaatgtccatcaaaggacaaacagattaaaaaatggtatataataaatacaatgaatattattcggccttaaaaattaagagattctgtcatttgcaccaacaaggatgaacctggaagacatacactaagtgaaataaaccagacacagaaagaaaaatatcacatgatcttacttaaatgtggaatcttaaagtaaaatatatagagatagagaataaaacagtggttatcagactgcggtggaggttgggagggcagaatggggagatacaggtcagagaatagtaagcagcagatttgtaggaagaaccagtctagagatctaacatacaacatgaagactgcaggtaaaactgtactgtatttgggattcctgccaaatgagtatactttagttgcccttgtcacaaaaacaaacacccaaaaaagtgagtaactatgtgagatgatgaatatgtgaatttgcttcattatagtaactattttactattttgtatatatgtcttaacaccatgttgtatacctcaaatacacacaataaaatttatttaaaaaccaacgaaaaagcacattcccttcataaatgagattcttttcaaaataagtttgaaaatatacattgtaaaatatactagaaaaaccaccccctaactaactccccacaacccaggagctctgatttgatagcttaagacaggataaatgactccgattaggacaatgagccccagttttatggggacctcctaaatcatatctcggtttgggtctagaatgatggtgctgggagcacccagagagctgcatatcatctcagcctggcttccacacagggagccagagagatttatggggccctgtctggtggctttgaggcacaaacgatgaatactgctaaagcaataacaataaaagaggcaacagacagtgggggaagccccagcaccaaccctcatttttctcataatatactctgttgtacaatgagacagagtgattccataggtaccagccagaaattacatgaaaaattgatcatgtttctttttctgggtgatatcagtgattgaggcccttgatttatgctggccaaactttttcagtgcagaatggaacccttcctaacttcagtctccgtggctcacacagactggccattaacagaagacacactgcatcataccatttagtcaggaccctacactaacagagggaactgcagcagagtcttaatagcaactccaatttgccaggaatctcaccacagatcagaaatttacagtggcggagaccttttaggaactttcagcatggatgctccctcaaggtgtgggtcagaatttgcggcgcaggaggtgaggtgaggtgaatagtttataatgatttttctatgccttttaacctttggaattaacatttggtcaagaaagccaattgaaggctaagtgtgtacttgacatgtgaaaaaatgaatgtgtcttctaggcgttggcttaggacactgctgagccctggctacagccaactcaggcttaactcattaaggtgattagccaacaatcaattctttaaaattagtaacataaaacaggccataccaggctcatggatataaaatttgggtatcaagttttgctccagagaaatgtcacaccctcaccggcaaaaagtctatagaggtagggagtgtcacaggtaaggttgagttaatgagacatcctctagctggcatgaatgtgtaaagtgcgctccatggtcatacatccagcaagtcaggatttcacagcaagcatagctttcactttaagctaagtgacatggaaggttcaggtccttaaccttaggtcacgggatgacaatatacagaatctgcagcttgacagcctgggcttaattcctagtcctgccactttccagctgtgggacctgagatagtcaacacctcagagcttcagatttcttgtttgtaaaatgaacccatctcagagggttgctgtgaggatcaaattggttagtactgcaaaatacccagactagtacttggaacttagtaagcatagatgtaaggtgtttgcagctatcattgctgctgccgctgccacgattattagtactacaactacttaaccacaaaatctgtgctacttgaccacaacatctttcagttaaaaaaaattcacaatttatttttttaatttaactttctcttaaggactttaccattgttttaaaaattactctactgaagtctaatttactaaatgggaacaggtagaagaaccattctcctaaaaactaatgtggagtcaatatacttatcctgggcatgaagaaaccctggagcttccaaagaacacagtgtgaaaaactttgcttggggagggagatggaaggcagagaacgagggtttctcccactggggtacaaatccttaggaagtggagcttggtgattaagagcatcgagctctaaagtcagatgagctgggatgaaatccccaccccaactttcatttcctgtgtgacctgtgaaggcagtcgaatatcttaattctttgggttctatatttataaaatgcagataataaagtctattcttcaaagggcttctgagaggattaaatgaaataatacatgaaaacctcttagcaccgcccctggcaccattagaaaatgccttataaatgtaagctgctcttctagttacttttacccagatctctgctcaagtgttacttccatagagaggacttccccaatttctatattacatataaacagttccggtcctatctcaaattaaaatctgcatttattcactttttcattttttgttcccatactcacggccatgatcccagcatctgtgactatgactagcacttagtaggcacccaataggtatgtgttaaatgaatgagttaaaaaggagagacaggaagtatctctaactcaatgttaagagactgcaaaaactctattaggctgaaaactaggaagtataattcttcaaagtaataacagaaataaaacttgaagacatgttcttttgtgtatgcaatagtgtatgctgattgttctcaagctgccaactacccttaacagtgctctgctgtgaagacacaaaaggggcaggagggtggatcagacagacttcatatgagccacaatgcaggtccagccaaagtagcaaggatacagttggaatataaatgcctttacccacctctcactgttttcttctcctgaaaattgctctacattatgatctctctctctttctctatctcttgtctcatacttggctttcctctgtccatgcaaagggcctccttgtgatatcccacattctcttttatcctgacacattgcatagactcctgttgtgggtactgtgtagttatataaccagagttgggatgttttactgccttgatgcttgcgttgtgggtctgtgtaatctttgcattcaaagtgtgataacagacactggacatagcgcataacactcagagctgcactccaggtactaagatgtcatgaggcccacgagagagatgcacatttctgcaagggcgtcaagggacccaggagaggaaggtaaaagccactacgaggtcctctgagggcaaacgctccctgctctctcctgacaatgatccccaatgcatgaagtaggatatagtgtgttaaggtgataagggctgaggatgaagtgggttggctcaactggcaaagcactgtgaactggaaatgtgttagtgtgtggaaaagcaatgttaccttggatgagagctcactcctctcgtgaactagacttttccctcaagtgccttcccccataatacagtcagtaaaatcttctaaagccctgagaactggaatcatctcacgatctatagtaacccaaagtggcctagcaactaggggtggaccctgttaactattcacatcgccaccctgacaaaagtcttcctgctcccatttcaaggctctctccacacttggtttctctgacctttctgaacctttcaccgtatcttgctctctggactgcagcccctggctgtgaatacatatttagtctctcagcctgcccttcctatagacatattatttgatgcttatgcaaagatcacccttagccttcatctttccatgcctttgccatacactaccttcctcctccccacactcctgtagtcagatgtgatgcttcaaactcagcttgagcgcaggtctcattttcaccctcctcatacgcctgtggacaagtttgtcagaccattggttaaatattcgaccaagagtgaggttggtaaaaggaaggcatatttacgagacagaacaaaggctttgcattaaacaaaacaaaatggcagttttccttcttgctgaaaccctcacttggatattcctccagaatcagagctttccaagactccacatgattcatcccctctcccatacttagctgtctggattacagcccttagttctttttttattttttagagacacggtcttgctctgttgcccaggctggagtgcagtggtgcaatcatagctctctgcagcctctacctcccaggctcaagtgatcctcccacctcaggctcccaaaaagcttggactacaggcatgcaccacattggctaatatttttttaaattatttgtacagacagagtctcactatgttgtccaggctgctctcaaactcctgggctcaagcaatcctcccacctcggcctcccaaagtgctgggattacaagcatgacccactgtgcctggcttcctagttctctataggagtctctaggttgttctgcctgagagattctgatagttcagctagtttcaaccagaatgctgaacccattattttgagcatgaatctgctctcctgttatattactaagaagaaaaacaaggtattccattaaatctgtgggcacatcctcaaaagcacatagttttgccgagatcttacacctgacaatggaagtgcttgcacgatgcaggtagtaaaacggaaaataggaatcaggaagctgatcaggaaccagctcagggctttgaaaaggagaaggccagtgagcgcccaccatttgcaggttgacagagtcaattttttttttaaacctgggctcaaagagagattaggcagctggatggggagcagactaaaaaatatgttcacctttaaataaatcagcaacgaaattggaggaggattatacctcagggacaaaagaggaagaagaacatgaatacctgctttacttgaaatgcctcccttctcccagcctttcctgcatggagtatgacaagagaggcccttggtaaccttcactttaattagaatcattaactgcaaatggaagtaagaacaactcaactctccttgtctaattacaggggctaccttactcctgtctgtaaaaggcaccaatattgtcctatgaggccctggcatgaagactttgctactctctcaagtaccaagaacagccttggagtggaagaaagaacatatttgactctaccatggaaattcttctatacctcaacatcattccttcatcatactcacatcctggcttgacagaacttatgtatccctgaaagccaaaggcagcttaagggacaggatagtggagaaaaatgcagccctggaactagactccttgtgcatgcatcctcatcacaccactgactgctacctggagcaaattacttcatatctccagattccagtttcctcatccgtaagaaaggcacaacaccactgtctacatctcatcatagtttttccctgacaattaataatacattacataaaataaatctttaataaagtcctaggactcagtactaggtactgtctaaatactagctatgatttaacatttttattggtaaagttttagaaacacttgctttgagattatggattcaaaggaaggtacaaaatagtacagagagatccctggtagtgtactcttcatctagtttctcaaagtactatgctgacatagtttataaaatataacatacctatagtacaatatcaaacccaggacactgacattggtacaatgcgtgtgtatagttagttcaatgccattttatctcatgtggagattggtataactaccattgcgctcaagatacagaatgaatccattaccacccaaatcaccattgtaatcctttggggaggcactcctgttccttctcctccatccattacaagactggcaaccccacaaccactaatctgttctccacctccacactttcgtttatttttcttgaatggtgcaataatatgctgccctttattaaacatttttttcttttttttttatttaaacttttattttaggttcaagagtttaagcgcaagtttgttatatagggaaattgtaagtcacaggggtttcgtataaatattttttcatcacccaggtaacaggcatagtacccaatgggtaattctttgatccgctcccttcacccaccttctacactcaaatatgtcctggtgtctattgtttctttctctgtatccaagtgtactaaatgattagctcccacttataagtgggaatatgcagtatttggttttctgttcctatgttaatttgcttaggatactagccttcagctccataaatgttgctgcagaggacatgatctcattcttttttgtggctgcatagtactccatggtgcatatttagtacattttctttgtccagtctaccttggatgggcttttaggttgattatatgcctttgctattatgaaaactactgcaatgaatatgtctatgtatgtgtctttatggtaggatgatttattttcctttgtgtatatactcagcactgggattgctgggctgaatagtagttctgtattaagttgagaaattgccaaacaaccttccacaatggctgagctagtttacattcccacaagcagtgtataagcagtccccttcctccacaacctcaccactacctgctattttttgacttgttagtaatagccattctgaatggtatgagatggtatcttattgtgtttttgatttgcatttctctaatgattagtgatgttgagcattttttcatctgcttgttggcctcatgtatgtcttcttttgagaagtatctgttcatgtcctttgccaacttttaaatagggttgtttttgcttgttaatttatttaaattccttatagagtctgaatcttatacttttgtcagatgcatagtttgcaaatattttctcccattctctaggttgtctgtttactctgttgatagtttcttttgctatgcataagctctttagcttaattaggttccatttgtctttttttttttttggtcacaattgcttttggcatctttgtcatgaaatattttccagagaccgtgtacagaatggtatttcctaagttatcttccagagtttttacatttaagtcttcagtagttttaggttttacatttaagtctttaatccatcttgagtttatttttgcatacattaaaaggaaggggtccagtttcagtcttctgcatatggctagtcagttattcaagcaccatttattgaaaaaggagtcctttccccttttggtcagctttgttgaagatcagatggttgtaggtttgcagctttatttctgggctctctattctgttccattggtctgtgagtctggttttgtaccagtaccatgctgttttggctactgtagccttgtagtacagtttgaagtcagataatgtgatgcctccagcttcactttttgcttaggactgctttggctattctggctctttttagattccatatgaattttagaataaatttttctaattctgtgagaagtcacgttggtagtttgataggaacaggacagaatctataaattgctttgggcagtgtggccattttaacagtattgattcttcctatccacgagcatggaatgtttctccatttgtgttgtctctgatttctttcaggagtgttttataattctcaatgtaaagatctttcacctccatggttagatgtattaggtatttttttgtgtgtgtttgactattgtgaatgggactgcattcttgatttggctctcaccttgaatactgttggtgtatagaaaaagctactaattttttacattgattttgtatgctgaaaccttgctgaagttgtttatcaaattaaagagcttttggacagagactacagggtttcccaggcataaaatcatatcatttccaacagatggtttaacttcccgtcttgctatttatatgccttttatttctttctcttgactgattgctctggctaggacttccagtactatgttgaaaaggagtggtgagagtgggcatccttgttttattacagttctcaaggggaatgcttccagcttttgttcatttggtatgatgttggctatggatttgtcattattattttgaggtaagttcattcttccaatgcctagtttgttgaggatttttaacaagaaggatgtctaattttatcaaaaggcttttctacatctattgagataatcatgtggtttttgtttttagttctgtttttgtgatgaatcacatttattgatttgtatatattgagtcaaccttgcatgccagggataaagcctacttgatcatagtggattagctttttgatgcgctgctggattcagtttgctagtatttggttgcggatttttatatctatgttcatcaaagatactggcctgaacttttctatttttattgtgtctctgccagattttggtatcagaaaaatgctggcctcacagaaggagttagggagaaggtcctcctcctacatttttcagaatagtttcagtgggaatagtaccagctcctctttatatgtctagtagaatttggctgtgaatctgtctggtccgtggctttttctagttgttgggcaatttattactgattcaattttggaaatgttattggtctgtccagggtttccgtttcttcccggttcaatcttaacaggttgcatatttccagaaatttatccacttcttgtacgttttctaatttgtgtgcatagaagtagtagtaatagtctctggggagttttttggtatttctggggggttggtggtaatgtcccctttgtcatttctaactttgtttatttgaatcttcttttttccttattagtctagctagtggtctatcaatctgattaattttttcaaagacccaatttatggttttgttgatcttttgtatggttttccatgtcttaatttcattcagtttagctccgattttatttgatgctctgagggtttgattatggtataagaggttcagttgatgagcttcatttctggaagatttcagggggccacggcttagctcagcactcctgggggagtatgctgcaaccctgggggggctggtaccagtcccccagctttgttctctgcccctcaaggttaagaacctgctgtgctggaggggcataggtgttccccatcttctggaaacaacactctgacagaggatgctggccaaagcacttcactggggcagtggcagcaggatccatgcttactagcatgtgctggcaacagtggcagaatggtgggtgtatgccaattttgtttttttgaaaatctatataaaagactcctatattatctgaccttttaaagtgggcttttgtcatttaacattaatgcccttgagatccatacaagctgttttgtgtattaatagtttgttcctttttattgctgggtaatattctatggtatagatgtaccactgtttgtttaaccattcacctgctgaagaaccttttgactgtgtccagttttcagctactataaactacctgtgaacattcattcatgtacagatttttgtgtacacataggtttccctttctctgggataaatgcccttgggtgcaattgttgggtcctatgataagtatacgtttggtttttaagaaatcactcggccaggcgcagtagatcacacatgtaatcccagcactttgggaggccaacgtgggtagatcataaggtcaggacatcgagaccatcctggccaacatagtgaaaccccgtctccactaaaaatacaaaaaaaaaaaaaaaaaaattagccgggcatagtggcatgtgcctatagtcccagctacttgggaggctgagtcaggagaattgcttgaatttgggaggtggaggttgcagtgagctgagatcatgccactgcactccagcctgggcaacagagcgagattctgtctaaaaaaaataaaaataaaaaaaaataaataaataaaaaataaataaatcactattttccagagtagtagttgtcttctatatttccatcagagagatttggtttctgttaccctcaccagcatctggtgctgtcattttaaaaattgtcctaatgtatgcagtgataactcatcatggccttaatttgcatttccctatgggctggtgacgttgagtatcttttcatgtgctacgtgccaccctttattatcttcaatgaaatgtctatttatgtcttttgtccactctacttgtattgttcattttttctatcataaagttttttttttccccacagttccatgaatactatagactttttttcctttttcaacttttattttagacttgggggaacatgtgcaggtttgttacctgagtaaaggtaactactgtgtgaagctgaggtttgggggatgaatgatcctgttacccaggcagtgagcataggacccaatagttggtttttcaacccttacctcctcttcctctccctctactcaagtaatccatagtctatattgttaccatctttatgtccatgagtacctgatgtttagctcccttttgtgagaacacacatataccagagttttgagaattcattatatcttctagatatgagtccttcatcagtaactttttaagtttcagagatcctctctcattcccttcaactacgagtgatctcttctttccctaacttctttacaaattttcacataggaccttttatcctgtctatcttgagtctgccatagatggccctccctaactgcctcactcatctatgaacaggctctatttctgatttgtcatcactcagtgtcttgctaacatttgggcacctatctggcattccactaatgtccaccaagtgactgaatcaactatacctggattttcattcagttactataagacttcagcctaaagcaaaagccacggttaccatggatacgcaggcttgggatagatatgtatcctaagcatttaatactttggaaaggataactaattacaaaaagaaatacacacactcagatgtgttagtgattaatttcttctcagctaccacacttctagctaacgctgtgacacactaacgtttattgaggagtttctatttacgccaacctggggctcacatttggctaattaagaacacatacatttcagaacttgtgatctgtgggctgtgtttacatatgaacatcatattcaatacacaggcaattgtttagcacctctaacctatttctagccttatatttaattagtgagaattgctgatggggaacgcagggtatgactttgcattaaacaaacagctatcctccttacaaatcacaacaacaatgcataattaaacaatgagctacctgagctttattcagtctttcttccaaaggaattaaatctctaatgaggaccaggcctcaggaggaactgcagaaggaatagaggtaaggagacataggggtcaattctagccctgcttcctggcctttctgggtcttaatgtccttattgtgagatgaggaaatgaatactcctccctggctccccatccttctcttcttctctctggtatgcatgttctaaagatcacatgcaataacagaggcaaatctctttgctaaagtaaagcataatataaaatataagaattgtcactgctgtgagttaagaggatttcattatttttacactggagaagaaaaacaattgccattaaacaggttctccatgacctgtccccatctcttccctgccctcatcacctgtccttcctctccctgttcacatgtaccagccacctgaccttgctttgctccttcccatcatatcaggcacatgccagccttgggcaaatccccctcctcatcaaagcctttccatgaccgatcctccaattgaaactatcactcactcccctcttatatcacttcttttaatacagtcagagtacttgccactgtctaaaaaaactgtttgtttacttgttttcttttcttttcttttctgcttttcctactattctctcctgcttttcctactactctccaccagaatcaggagcagtaaactcaatggctctgtcttacttccatgctacaaactcaggtgagttcactgtagcctccaggagggaaatgtacattatgttctctgggacaaagctcccaggcaacaggcaaaaatgttccttttattctacacaactttggaaaacacctctgaatccaacgttgagagccatcatccttatgctgagtactcaagagctcccaggattctacagcccataaatgagacaatttgacaagagtcactagtggtgaccacagtaatagtattaggatgaaccacatgaaatcactgagattcactgttttggccctaaccactttcatatggtttggcatagtaacaacaatggcagcaggagcccttgctacatgccaggctttgtattaaggctttaatagatactagttcattcacttcccaccacaatcttataacctaagtattaattacctatgtgttatgcatggaaacagcaaggcttaggaaggttaagggatttttccagaggagaggtggtagcatcaggtcacaaacttaaccccgtattatcctggaagagctaatgtgtgttcccttcctagggaccaccatgaacccacctgggttctgtgcatggaaataacacagaaatggaagttgctgttttttgctttattgcctccacgactttgtagccattgctgttgactgggaatctctaaattacaccaacactcagggtcatctgagttgacaactttcatggccacggccactacgcccaagaaaaaaataagttggaggtaaaatggggtataaaactatcttctagcactttctgctaattgtcttttacccagacaaggaactctgaaggactctgacatcagtttgcgatgcctcagctacctctgtcctttggccatctctgacccttcagccaacttgggaccctcagtcctggtaagagatcatcaggccttgtgccccccaccccaccatcttggtgagctgactctttcttgctcacaccatacctaagttccaaatagaactttagggcatctgagatcccacacaggcctccccactgctgggatcaatgataaccatctcatggaaagcctcttcattgagatgtccccagttacatcaccccaccagcccagcattctcctggctcacctctctccagccacagaatttgcatctcacagctgagaaatgggattggtcttctcctctctccatgtctctgaaaacatcactcaaccaccttggctcaatagtctcctgcttcaaccagtgccactgagcatgccaatctctttttgtcatgttgacatcatgtgtggccttgatttgcctcccccaaattcctcctaggatggcccttctcacagccttgatctcatcctgggcacctaaaggggtactgagaatggtccctcccacagctttgactgaaagttcttggattccttctatatccagtcaatttcactaccttctactttagctacttagtcttgcggatgtttgaattttttggacactggatttttttcatcgtataaatgatttcacatcccaaatctgacattatgtaacacctctttcctgaacaacctgccgagtttgtctataagaccacccacactgtgcattaagttcaccaggtataaaacataggtggccattgcaccaccaaagccagtatcccagacacagtgggttggagaccctcgggacatgcagacatctccccactcccagtcagccatctgactctgtggagtctcctccctctcttgttaccattcctcagttgtgccaatgtgacacgccacttccagactctcacctcccctgaccaaagctagaggcatggcctttcaatgatctcggcttgtggtctcaccatagagtctatatgccacattcctgctcaacatctagaggtgtcacttcaagctaccctcccattatagggtattaagctctgaagttagccagtaagggggaaaacatggttaaaccactctggaaagatcccttaaactgaccaaccttcaacaaatctgaaaagtctaatttctttttcttggaaccaagcgctggttctgcatttgaacacaagttggagtcctggttaggatttggagggctagagggtgcaaaaacgtccttatccattagggtcacactcatcacagcaagatgctccccttgtggacagctgtgtgggacggcagccagtgaagaggagactagccactctgaagcctacgttccttgagtagaatggtccacaatctaaatctaggggttcactccttctctccctctgcatttgtctctctttccatgtctgcttgtgtctgtctctccaccccccgaagtgtgtgtctgggtgtttctctctgaatctcggtcccctagcgtatgttgtgtctgtctttatgtacgtatctgtgtgtacctggctctgtgtctctctcagcatgttactgtgtttccatgtgtgtaagggtaaatctcccctgtctctatctcttcttgtctttctctgcatctgtccctgtctctacgtgtgtacctctttcttggtttctctgtggctgtctctctgtttctctctcggtcttgatgtctctctgtgtgagtgtctctctctccttatgactgtcttcatgcgtgcattgggtccttgtgtgcatgtcctcctcctccagtgagtgtctccctatgcacacatttcttgaggtgtagggctctgcaaaacacttagagttgacccatttcaaatatgttagccgcacatgattcccggccaggtatgccagcgctgccctcttctgcattgccacgcagacgcctaccttggtcgaaacacttgcagacatatctttagcaaggtatctttcctcgtttttccccaacaaaactcatgctgtaggaatctccaacatatacaatgaaagagtattgagctgccatagataaattaagtactgtgctcggcctcccactcagcaccaagaggccaaacagaatctaaaaccactgctgacacctagcacaccaaacctttccagcctctgcaactggcattctctgcatgtcaaaaacctctgaatcattctgggtcaagcacacatgcctcctttcacaaaggttctgcaaacaggtagcatcctgtaccccgagtgtgtgcctggtacctactggtgtacccccttctcattgagaggtcctgatgcctgtggtgtgagtcagtttgagtgtgttaatggagtgttctgctttcaaggccaaactgcataagcagagcccatccttttcccttcttttgtgcccagatgggaggaatttgtgaaacttgtattccagtgttaatgctgaagttgggaaatggctcaatcaagcaatggcagtttaacttgaagagtgcaaaggagaagagcagggagaaaaccaacactggaagcaaatcagaaggccagaaaccttcatgggcacttgcactattgtttacagccacaataatcatgtaagggaacccagcatttttcagaagttattttgttctgtttttttttcttttttttccaaatgtgtgtttgtattgctttgtttaaatataggcctgattcattcaggcttgggtctgaagatcccaggctttcagaactcaacaaagctttcatcatttgcaaataattcaactcaacaaatatcatttgagaaaagctctgtgctagtgcttcttgtagagacacaatgaagaaaaaatcacggtccctgctctttggagacaaataacttaggggaaaacacacacacctctcaactctcacctaaggagtgctgtgcaaagtgctgaaggagatggagactcctctcctgggaaaatctgcaattcgaaactcaaaagaagatgaggctaagggccctccaggtggaggaacagcctgagtaaatgcctagaaaggaatggcacatagtaggcacttgcaatcaaagctttgctaaatgaatgcatgttgaacatgttccagaaaactcaagaccagagtagcactgagaagtagaggtgtttcagggcttccttttagaaatttcttatactgaaggtttcagaatgctaggagggaccagggagatggtttattccaactggtttcttttgaaaacgaagaaaccaaaaacccaagcttacatgctagggccagaaatgagatgagaactcagaactgttccagaaggtaatcactttgaatttaaatgcctactcttctgatctcaatttaaggaactaaaacaaaatcagcagtactgtttgctagttttctgtgaatcattcagaccctggagaagccagcttcacttttgaaagctgagctgatccacttacaactgtgtggctaggttcccattactgagtctcagtcttcacaactgtaatataggaaaaacaacagtagctatcgtacagcgtagttgtaaagattcagtgagatcatgtacaaaaacagctcttaacaaggtcatcagtgaccttcactttgccaaactcaatggacattttttgtccccatctcactagacctctgggcagtggcatctggcacaaaggggctgctccttccccaaaacaccccggcaccggctcctgggatagccttctttcctgctattctttctttctggatgttcctcggtctccattgccaagtcctcttctatccaatttctaaatgttggcaaactgcaagagctcaattctatatcctcttatcttccccagcgacacacttttctcattgaacccattcagcccctccgctttacacaccatccaaatgttgctggcacacacttttatatccctagctcccacttctccgctggttgtcagactcaaatatcaaactacctgcttgagatctccatgtggaagtcatagaagagtctcaacccaatatgtcaaaaactgaactctccattgccccattcccaaacttagtttttcctcacctgcttaaatggtattgatactcaaccatgacttaagccagaaatctaagagtcattcacagcacctcctctccccctctcccaacatctgccatcaggtcctaaatttcatttgtgatatatatgttaaccgtatacgtttttctttatttctaccaccagcactgtctctcatctgaatgacggcaatcacctcctaactccactcctgtatctccacagtcagttctctgcccagcaaccgccatggtgtgtaacaaatgaaactgatcccagtactctgtgttccatccatcagtggcttcctcttgttcatagaataaaggatgaaacctgaaatacttcttcaaacttctccaggatctactcacaaaaatcctctggcacagctctcttcttctatcatttggctgcatttctacttgcctatttttcatactcggaacaatcatgctttttgtagagccagggccctcacatgtgttgctcaggtctttagtcagcaaactcttcttccttaatctagtggttaaaagccccagctctggagtcaaactgacaggggctgggtgactaaagacagtcttctggccaggcatggtggctcacatctgtaatcccagcacacagcctcccaggaggatcacctgagcccaggagtttgagaccagtctgggcaacgaagcaagacctatttgccaaaaaagaaaaagaaaaaaggccgggcatggtggctcacgcctataatctcagcactttgggaggccgaggcgggcagatcttgaggtcaagagatcgagaccatcctggccaacatggtgaaacctcatctctactaaaaatacaaacattagctgggcttggtggtgtgcatctatagtcccagctacttgggaggctgaaccaggagaattgcttgaacccgggagggagaggttaccgtgagccaagatcgcgccactgcactccagcctggtgacagaacaagactgtctccaaaaataaaaaaaagacaatctccttagtaaaactatgtaccttactttaatcatctgtaaaatggggataagaacagtagccacctcacatagtggtgaatattcaataaaacaaaatgtgtgaagcactgaaactactacctggcagaagaaaaacactcagtaaacattattgtcaaaaatccctatcatcctttagttctcatcttaaatgtttctgcttaaagcactctccattactctaaccctcagttttaatccattttatttcctagtactaatctaaattggtcatcaaatattgattttgagacttattgtccatttctgcctctcaaattacactctacagaacagggactttgtctgtgtttccttcagtcctggaaacctggcagaggagctgaggaactgagctttacaggctgagttctgtgaccctgtgattattatgttgaagccctcatccccagtacctctcaatgtgactttaattggaggcaggggctttaaagaggaaagtaagttaaagtgagaccatcaagttaaaattatgccctaattcagtctgtctggtgtatgtataagaagagagggaatttggatacacaaagagaaaccaggggtgtgcattcgagagaaaagattgtgtgaagatagagcaagaaggtggctagctggatgctcacaagaggggcctcaggggaaatcaactctgctgacaccttggtctttggcttccagcctccagaacggtgagaaaataaatgtcttttgtttacaccacctaatctgtagcatttttgttatatctaccataaaaactaatgcagtcagtaaagactgatgagtgaatggatgaatgtgtcaacccagtgctcagcacaaggtaagtatgcacaaaggttgactcctattcctgaaataatgatgatgaatgtaataacatctcaggagcaaatctaaccaatgcacattgaccaagtcactgagaaaaatatgtctcagtggcacttacagtgcttttcacctgtaatactgaagtgaaatgtgattagctatgaagatctgagaccttcctttaggagccagcacatactactctatgacttctgtttacttaatttgtacatgttggaacttgactgttttatggtagactcttggctatacaacatggaacactagacatttccatactcagtaaacaaatatttctcagacatgacagcaaaactagaaatgagaatattagattaatacttccaaaataacagcctcatcgttttaatcaacatgtccttgaacacgtttgaatgtgtgtgtaactgtgtgggaatgtgagctacatgtgtatttttccactgaaggtgaccataccatatgcaagagcaggatctcaaattagatattcagcataggtagccatattatccacatctaccaactgtcttcaaattaaagcccttctctagctggaacatgtatctgtcactggaaagtaggcagtgttgaaaatcatgacaaaattggcacatatcttgatagttgcatcatcttttctgtggcagtccccagtaatagagcttcatctaattcagcaaactattagctcataataagaaacagcatgtgtattgattcttttaatagatcttggaattaatacacatgattcctataaaaggactgtataaaaaaaatcaccaagttgattattgcacaatgaggtctcactcaaatggcataggctacggcagaaaggtaggcaattcctcttttgaaaaaaactctccatcttacagactgattctctcctgaggaagaaaaaatataatgaagtgctataattaggtatctcacatgtaagggaagataacaaaatcaggaacagcaaataggtttttactgagtgtcaactccattcaattagctgcagctacctagagggttgtattaagaagcccaaggtcgacagtaaacaatgccttggtgaaataatgatgttggctagggttgcaaaatgatgagtagatggccgctatgtaatttctactctgaaacagatgtcactaaagtctcttccggggccaaccttctatgactctctccttttttctcctcttccctcactcttgctcttggagttgggatgaataagttagcatctcctgagaatcccaactttctcctcttatataaagtggtcaggctcagttttcagtatcaggattcaaagcagcaacctctgtcattacaatcatgtgtcgctttggtataggcattgaaaagctgtaccagggtgctgactgtcacttaagtaattagactaaactataataaacaagaagagatcactgctggagacccacatttgttaatgacctccagggtcctctcccctggcaagagatagacagatgaggtaccaggagtgcaggcctccttgcacgtataatgacaacagccagacaacaatgcaacaaaaatggtcccatgtcctgttctgtgtgtatagggagagtgatgacaatcatcattaccaccagaactaccaaatttcctctccagttctttgatgcttctcaatcattgtcggagctaccctttaaagatgtctcaccatgaacagttactatgacaagatactaagaagagagtgtttcatttaaccccttccatcactacccctatgagacatgattgcctttacttgacaggaaaatgaggttcagggaggttaaatgtatgtagaagattttagcaagaatattctgacttgaaatctatgttcttaatgatttaggataccagctcacaactcaaagcatgaagcatgtggcaatactataggaggtaagagatctcatgacaggaaactcgggttattcattcattcatccatctagtcattcatccatgcatatatccatctctccactcagtcactgtgtcaacagatatttaccatgtaactatctctgtacttggtactggggcagaggtgagcaaaacagataaagcccctggcctcacagtgttcacagtctaatgaaagcacaaacatcaatcagtgacattactgtgcaatcacaaattgagataatacttgaaaggaaagtaatgggagcctatgacaaagatctggatttggggtagggtcagatttaagaaaatgagacctgagagctgaactgataggcaagttgacattaattaggtggaaggcaggtgaaagaatggggctagagaactaataaggagataataacatatgtagaggttcatggaggaagggaatataaagtattcaaggagctatgagccagagcacatcgagcaggtcaatgagggaaagagtggtatgagaaaaacctggaaaggcagagaggaggtggaccatattaaggtgcatagggtggcagtggaaaccactgaaaaatttgagagagaggaagacagtgggtggaagaaaggggacaactgtgattgttcagacttcagtgaccacaaacaatacagggagcatggtgagatcagaatggagatgcagcaacctgtaacaggtcacttagttcagatcagagacacttggtagctttgattaggtgatggtggtagagatgagcagaaatggatggatttaagaaatattgtggggtaaaatctaaagcacttactgataaattggatttgggaagatgaggaagcaggaggcaaggataatccctagatttctgacctgaccagatagatgttgctactcactggctggcaacttcacaaggtggccttgttgactttggaataccttttgggcatcctagtggagtggcctaaaagggagttaggttttacatgttaggagttcagaaaagaggtctggggtggagacattatcttgacagtcagttttatagctagaaatggttgaggctttgggatagatagagaaggggtactttggaaaacaatgttcatggaaagcaataaacattctcgtcaatcactatattcttctaatacacttcttccttttgttatgagcatctgcatctttcttcctcttgcgtttcaataaaagcttctatttttaattacacttcccttggttctaatttttaaaagtattttgcatatctgttttatactatgtatccctataaccactccaacttttgtagaatgaggagagaggaccaattactagttttcagaagatccacatgagactccaaatggtcaaattatcctgacagcgaacccagcaaggaatagattaaatttgaatagtgcactcaaaaggactatctttgagactctaagacgattcttgattcattcatttcgtgaaagccaaaatgtccgaaagtggtttgcggatgaggggactgaatcgtgaatttgaggcctaaagaatttcccaatgttcagccttatggtggattaaatttaccatgactaattggaggattcaaagctgttaggaacactagctattagggccatttttctcatcttcgatcttactgcttgactgattcatagctggaactgctaggccgttatggaaatggaaatgcagagatgaagcagttcccaatgtcaaaaacttccagggacatgtaaatacaatacacgtaccaagtaatgagtttaattacttaattattagatactgagcactaaaatttaactaacacctggttccataaggaaaaaaatacttcatttcgctgtacttatagctctttattatgccttttgaattatctgaaatccactgatgtacgggtaaaaaactcctgcagctagctcagtgtctgtccaaatggccacccagttttgtgcttgaaatccaggaccccactggtgtaggcatctgtggggaatctcctggtctgtgggttgtgaagaccatgggaaaagcgtggtatctgggctggagcgcaccattcctcaaggcacggtcccacatggcttcccttggctaggggagggagttccctgaccccttgtgcttcccaagtgaggcgacaccccaccctgcttcccctcgccccctgtgggctgcacccactgtctaaccagtcccagtgagatgagccaggtacctcagttggaaatgcagaaagcacctgccttctgcattgatctcgctggaagctgtagcccagagctgttcctattcggccatcttgacagccaccaccccatttttcaattttttttatgacaggctaactgtgggctttcctaagagacatgagagtagtatccttcccctacaatcctcaggcctagcatggtgtctggcatataacaaataaatcaatgcagcctctcaaggaatcctcaaaatacagcagaatcattctagaaaacaattcatttcgattaaagaaatgaacaccatagagatgttccattggaagacttttgaaccaaaacatttaattcgccagtcctgaccatatctataacaaaaggaactatgtctttaacgtatttttcttgaaagccagttcatatggttgagagagcttataaggaatactaaaatagggaatataatcagccttctgtttttgagcaaaagtgctgtcaactagagatggggctcttggaaaatactttatactgcctgttctcagtttttttcttcttaagagctacttcatttcattgttcaaagtttagtgagagccaaaagaaaatacaatctatttacaataaacctatactttccagaatcaccttaaattatttctgctaactctaagcataaatcaaaagttctgaaaagcagaatggcctaaagaggaaatatgtcatttgtgtagttttgggaggggagggagtctgttaggaaagataaattattattgtcctaagcaaaaggacagctaatgaattcctaaatgacagggtttaatcctcaggcttgttgactacaaggttatagagctttcttcctttccattgttaaggagatatttaaatgtaaacatcttttctaaccttggaaggaaactgatggaaaacagtgagtattttcttggtgcaatttaaatattaaattcaaacttaaagcaattgttcacacatgcatttgctagctcaagaacacaaacataatctgtgggaataagaatcacaataaatgaaataataatagaacaactgaatccatcaatttttctagcatatatacactaagcaaatagtttgcactttgcataggattcagcattgccaatattttatttctaataagccaggtataataagaaaagcaaaatgtattggccaggtgcagtggcccatgcctgtaatcccagcactttgggaggccaaagcgggcagatcacgaggtcaggagatacagaccatcctggctaacacggtgaaaccccatctctaccaaaaatacacacacataaaaaaaaatttgctgggcatggtggcaggcacctgtagtccccagctacttgggaggctgaggcagcagaatggcgtgaacccaggaggtggagttcgcaatgagccgagatcacaccactgcactccagcctgggtgacagagcgagactccatctcaaaaaataataataataataataataaaagaaaagaaaaatgtattgttagtcttaaatattttctggttttaaattgagtcgaaaactcatggctcaagttcatttaaagtccaagtctgaattctaaaggttaaatgctagtaccgttagttcctcaaattattcacttgttttttatttttgttacatgagagagagaaggaggaggagagagagagagagacagaaagagatatcacagaattagaacttgaatctcattcagtggatagggatgagaagaaaaatgaacattcacagagcgcctaacatgtttcacgtatccaagtatcacatcaggaactttcatacttatgatttcatttattcctaaaaattaagtaactaagtttcagaaaaatagagtgacttgctaaagataattcagtgactgagtggtggaatcccagttttgaagatagagctctttgactccaagaagaattctcaatccataaagctttactacaaattagggaaaatggcttatctttaaaatagcgtgtgaataaataaatgagtaaagtttccatggggacataggcagcaaattaacagaacacaatttaaaatgttggatgtaaactaataaacagatgcatgtcactaaaacgtcacatttttcatcgtaacagtgtattatctgttggcaaagacctcagtaaagctgtttttatacaacagaagcacagctggctaaaaacagaacaaatgtggtcaaccaactaaaattttcaattcgttcaatgccaagaatctgcatggaatgacgttttaaataaaacaacctgaaagtaagctgacccataacaatttggtttttatctttaataactttaaatttttggttaatgtctctataaacagcctacatattattcagggtaaaggctcaaatatattatactaaaattgcttttagacccagaaaattcctttgcatggaggtatgaaaaaggaacatttgaaattagcttgaaatttgggtgtatttcagatatgacatgccattcacattcatgtgtttccattccccatgaacaatgggctgcgtgggccagtatcaatcatctattaatccagaactttccatactacctattagttaataaagtacattgacatccattaccccatgtgatgggatatttaacacacttccagaacatagaataaaaataaaggggtttatactttacctagaaggctagtgacttaagaattttggtgggaagtttcatccactagaggaaaagtcttatgattatgtggaaattatttatcacatgcccccaacaaaccccacaacatcacaatagacaaatagtggtgctcaaatagtgaacattatggaaataagggagaacatacatctctacccattcccaatagttttgaacttaggtatttataaaattaatttcatgatgctgcacataaatcttaattctaatgtgcataaacagaaaaaagcaagttgtataattattctgtgttattatttttaaaagccctatatatcaaaccaaaacaaatcaatataatgccaccaatgtgaatatcattaggctcagcatcttaaactcagcatgatatccatcgggccataaatttgaaggaaaatattcaataccagtttcataaatcatattaacattaggagaaaatctattatagcacaaagtcttattcaagggaaaatcatgttcataggaattaaacaaacaaaaaaacacttgtggccctctgctctattatccttaaattttaggaaataactaattataggagagttttcagtcatgtaaatcagagagttagcaaaacaatggttatattatgacagcaatcaataatagcatgcatttttattaaaacattactttctaaatttgtagggctttaaattgtctagcagaacacagcttgaagtatgatatatggatggaggttcatagaaaatatagtgtatgggaaatacagactccactcaggagatatatctgatttaaacacatgcatatatatgtgacaatatatatctaattatatactaaatctcacagaactacataaatatcttcttgcttgctttctacagtttctttaagaaaatattatttaagaggtgacaagtttcttgttgttgttgagcaacttgaattacttagtttcttgcagaactgtgtcttcttccagctagagtgtaaaatcacttggaatcataacatattcaaagagttttgtcttaacaaatccatgagtgatcaacttccttccatcctcaacaaagctgagaggtagaccttgccagttctaacctagcactggagtttaggtttattagatttagccagaaccttcaagtgattcttgaaatgaactttttaaagagaattaattaagcccaatttctagcctacatgattcccatgactatacatttatattagaattgatattcaaaactaactataaatatttaaaatccttttatcaacaaatgaaactagatcagcacagagaaagttgaactcaacttctaatttcctcctcttggctctatcaaacaagagcaaatcaaactggctgctaagagaactgatgaccaagacagactgggaaatgagacttctagggagtatgtcaccgtcttaaaggcctttctagactggatgaatagaaataactggcagataaaactgataaactgatttgaaaacatctaagtaaacatggccacatgcaaaggtatccagagaaagataattctagaatttgcagataaaactgctgaattgctttttggagcctgtgaagaattacagcagaggtattctaacaaagcagaggtattcaaacaaataagactcttagtattcaacctcccattgggcaaaaactagaagctggcacccaagagagaaagcacctctttcttgtcccccaagcatgtggcttggactggattttaccccaagtcccactgtagccagaaactttcatgtagggcataacctgtgcaactcacatatggttgtcctggatctaaatactgtataagaataaatatctctttatcaaaagaactaactacagctagccatgtgttacttaacaatggggatacatgctgagaagtatactagtatatttcacccttgtgcaaacatcatagagtgtactcatacaaacctagatggtacagctctctgcacagctaggctatatgctatacccttcagctcctaggttacaaaggtatagagcatgttactcacttaatactgtagttaatggtaacataatgataagtattcatgtatctaaataaatatagaaaagatacagtaaaactatggtataaaagataagaaatatggtattcctatatagggcacttaccatgaatggagcttgttggattggaagttgctttgggtgagtcagtgagtaaggggtgactgaatttgaaggcctggggcattactgtacatttctatagactttctgtacactgtatacttaggctatactaaatgaatcttctaaatttatgtaataaattaatcagcttactggaactttttaactttatcaactttaattttcttaactttttgacttttgtaataacatgtagcttaaaacacaaatacactgtacaggtatacaaaaatattttctttctttattctatttttaaaaccttttattttttactttttacacttttgtgttaaaaaccaacacacacacacacattagtctaggtctacacaaggtcaggatcatcagtatcactctcttctatgtccacatcttgtcccactgaaaggccttcaggggcactcaccatggagccgtcttctcctatgataacaatgcattcttctgcaatagtccctgaaggacctgcttgaagcggttttaaagttatctttttaaaaaaataataaatacactctaaaataacaataaaaaagtatagtatagtaagggtacaaactagtaacatagtcgtttattatcaagtattatgtactgaacataactgtacgtgtgatacttttatacgactggcagcatagctttgtttacaccagcactgctatgaacaagggaataatgcaatggactacaacgtaaagacagctacgacattgcaaggcagtaggaaattttcagctccattataatcttatagggccaccttcatacatgcggtctgtggttgactgaaattttatgcagtgcatgactactataaccttacaagcttgataaaaggcaggtaaaattctaaaatgcactgtttcagaagggttggtggaagcttggcaaaggtgttcacgaagagccagcatggctcccaaaggcacctcagtttctatgtttgttggataagcccagtagatccaaagaatgctacaaaatacaacatatagtatataaagctaccataattctgctttaggggaggatggagaagaaaagattagatgaacaaaggaagaaaagagtgaagaaaatgaagaaaaggagaaggaagaagaaagtctaagaaacataaaagaaaaaagaatggagaaaagatatcttagaaaatggaaaatgaaggaattaagaagaatcaggatatctgcaagttatatgacatactctctcacaatacctttgcgaagcatgtcattttcatctaacacagcagggctcaagcaagagtaatatagtaatattcaaaaagaccaggggtaggtagtcagttttccacctttaccaatatggaggaacactgatgtaaagaaaactatcacctatctttttagggaggcatttttagtgtataatcaggactttagaaggcaaactttctttaggctgtacccaccattgaccttaactgagaacacctctaccaaggtcagggggccaagactctccactccaggtgatgaaatcatacagtttcgatatgatttcacaatatgaactgtagatttttgataaagtaaaggcctggccagaaaaagggcagaaacctatatgaactttaaggtggtcagaaagctcagctctacttaagaaacacttttagactcactttagtaggctatcaaaacaaaaacaaaaacaaaaacaaaaaaagacacaaaaaggaaaaaaaaaatagttgtaccttcaagatatctcttgcaggaagcctagtccatcaagaaataaaccttcatctcccgattccaaaaatcagataccagcagttctcacaatgcctctagtggtaattctgtggttttatatcaagttctctatcctccccagagactcacagaaatggcatctcagcacttttaatccattactccccattaagtccattagttacataagcctagaagataccagtataggtcagcatgtgccaaagtgtgtttccacaagcactcaacgctgctagatgctaaaacacgctctgtgaacaaaagcgcttgctgtcaaatgcttttgagagatgctagagttaaacaaagctaaagttgtttatttgctgccagatttctgggagcctttcagatgccaatgcagcctgtggcagtgcaggaaagagaccaagaatgcaacatttcccacacattcttcactagggtctcttcatcttcgaattttgctgagcatcatcacagtcaactgctctaatgaacatattttgggaaatatacaaagaagaggtcagctaggtcatgtgagaaatccatgtttcgttcattgctcacacattaaattttctgcacaaacacattattctctgtgaaattatccttcactcgtagggaaaacaacaatagaagtcctctgcatctaaatccaaagggatctgagctgttctacgcatatttactgtgttgcttaagaatgtctcatggttctttcctatggcaatctccattccattattcaaaaatacaaattaatcacattctaagcaattgttcagtttccttcatttgtatgtggttgcagtctgtaagtgaaattccttaatttcttttctcaaagaaagcttctatccatacaaaacagtccccaaacccccaaattttgggctctaatatgagttaagtagaaaggtaaatgctaatgtttcattaatcctaacgcttgaatttcaccccaacctctgcagtgttctgctctctctgaagtgcttgtttgcttttcagttccccaaatttggctctggtaaaaacaaaacaaaacaaacaaacaaacactaatgggaacagtaactgtgttttgtataatttggggccattaccagctactttatgcttcatttgcgtacttgcgtgtattagatacattttgttaagttcacctaaggatatttccctcaatgggcacaaattcatggtgcctataaggtgactttagtacagcttcatcatctacactaatatttccagcagcccctcaaaagcgagatattttcttgaaagtaaaataacaaaacttactgtatgtctgatactgcagaggccacttaaattgtctataataagtccaaggaaaggatcgttgaagttaactggccttgggaatttcaagtacacctccctttgaaataaaaccatttccaaagaacgtcatgtcaaatgcacatctccctccagaaaattgtgttttcttttcaccccacccagaacataactgaatatcattttgctgggtagggaacctccctaacctgccttaagtctcatctatttccatttaaccatagttcccagctaacactacctctttcccaagtttacctctggcaagacaaaaaggatggtctttatgaacagatggtcttttcaaggtaaagtagttacatttaaatacagataaatgtactgtaaaaaacggctttaaaagaatttaggtctttaagggggaaaatatgagagcacaagacactattctttaattacatgagatttcttttttcttcccttgaagacaaaaccaattcctaatgaagcataatgaatcgtaaagaggcaccaatgctcatcccaacagatgtttattgattggtgttgactgaacacaaacacaagggtgttgcttactattgtcagtaagtggtgggaagcagcaccagttccccctggttattttacctttcaaagacaagctgacaaatttattttgtcacgagcagctgtgttcttatttttataagggttggcttacaactaagaaagcaagcggagggaacagccttttggtgtccaatgtgttatctggcaaggacagattgttttagggtgcaatggaaaagatttttaatgaaactacatttcaaacgagcagcatatgcttgattttcccttctgctactcatcctgccatttgttaatttttgttattgttgttctccgggactcctaaattttcatacaagctgtctcgtccggcactaacacagcttggggcgaattaatgcttgggatgcaaaaacctgcacgtcccactccagccatttttttttttttcatttctaaaatttctacattcaatcagggtttaaccggtgaactagttgacggaacaagcagggattaaaaaaaaaaaattcctcctctttgtgagtccttggagccccagagccagaaaatgtgacttcagaatatgtgtggacttgtcagcagctcagctgcacacaattatggggtcagagcccagattggaggtctggagaaactctgaaattgggaattaggacaaaatttttttctttttaacaccgtaatgccacatattaatttaaatgattctctcagaatgattctgtggcccagttaaatgaagttcaaggaaatgaatttcagcctttgacactctgagtcctatttgaaagtagtcggctttacaagattaaaaacaaattacagggaatacgaaatctttgattagcaggtgctttgatagctgcaagaatattttttctcaaaaatgtgaacacacatgggagaggcaccactattattatctttgtgtggaaggccttataatgaggattccattgtgtccagagactgaggacatgaattgctatgtctgaagggtcctggttcaagaggtgatttcagtaagacacagctgatagatagaacctaaggtttcatgggttcataaactctctttttttgctaacctcccataatcaattgaagaatttaagggactcacccctttctgtaggattcccttcataactaatgggaggcagaacttttcaacagagaaagagaatgctcgacatttttcaataccatgtgcatcaaccaatgggagaaaagggtcttggaagtttagacagagtctttggtcagctctgagctcaggaagactgaagtccatgtccaggttgccccattcactcattgtatgaccttgggcaagatacgtcaattctaaggagttcagttttctcgtctatactgtgggcatttcaagggtcactgtgcagatgaaacgagttaccacagggtgtggcatacagtaaaaacaagttaaatggcaacaaaatataatcagaaattgcaccaacgtcagtgccttattccatctcatttctcccattcagttagtttccaagttataagggttcaaccccttcatgctaggccctgtgcagacatgccttgctccatcacatgttcagccttgaatggataggaatgtccactgcttggtcactgttacagaactacacatatgagatgctccatcattatgtaactcatggaccagctagcaagatggcactagtgtcctagtgaggatgggtactcagaaccaagatattagagacagaatgtgccctgttaagttcagaacatataaagtaaatactctagagtttcagactaacttgatggaatattcaagaggcttgataagccctgaatggggccttgtgagacatagggccacttaaccttggacagtaagaatattattgccagcaactcaagtgtgtctctcatgaagaactggggctacctgtgaagcttggttcactagccatccccagactattccttggcatgtttggctgggaaggtatccttggcgctcactgtagtatcatacatttcagtagctctatgggtcagggttgatattctcaccaagcctccagcctaaacctctgagggtgcctattcttcattcctccagtgtcacctgtctcacacggggccagtcagctttttcctgcaggttccatcctgccccagattctgaaccaatcaaactccctgacaagtggaatccaagtcctatgagttcacagcttaaagtcttcacagcaagtcagaccaatgcctgaccctgctctgctcctgcaagtggcttataccctagtttagctcactgagtttctcttgtcttattcagtacaggtctcagtagtactcctgttcatttgggattggttttctaccttgtctcctcgaggttctctggaaaacagaagcaaaccagtatttgctggcccctacctagtgctttcatcaaattgatctacatgttgctcttcagtcacaggctccctcacttccgtatttttgctcctgacttatctcttcctcaaccccattctcaatctcagctcctctactgataaaatccctcccagttgaataccaactcttccatgaacctcagctagacagggtgtgtctccctcctctaactcttaaagtacttggtttctcaattctggtgcttctcactgcttcccatgatggcaattactgacatgtcttctctttctggttaaactcttgactgtcttccaaatgcatcttgccttatccactcgcatttcctctaatctgtcttccatcctaaccgtatagtgacgctcttgaaacacaattctgattccctctgtttctggccttcagtcatttcctaccatattaaaaatagagacttggatcccaaacgaagcctagaaggctttagttggccccattatctttactgccttatcttgcatttttggtcttctcttgccttgtgctcccaccacaccaacctctctcttctgccacaggccctctgcacatgctgtatccctccccaacctctgtctctgccttcactgacacctattcatcccttacaacccaattcaatcatgttttaaagaagatctcttgtggtctttccaactaggccagttttccctaagatatcctaccacaaacatgtcttctttatagcataaagatgtaattttaagttttttattaatttcctgctatcccactagattgtaacctccctgatggcaagaaccatgttagattttgttcaacatttcatccccataagttctgagaatatttatataatagttgctcaattaaatatttgctgattgaagttattttgggccaaagaccaggtttcatttttcttctcagcccactgatttctggcacaaaggagaggttccataactaactgttcaccaccaatgaaaatacaggtataatgtttaaaagcttcctatttcttcttgtggtactattaagtaggaccagagcagcagtacttcacaggggtagtgtggcatcttcaagtacaatgatttgtaggggataaagaaaagaaaaaaaaaacccacaaaactagtttgtgccacatataaggaagaatatggttctcttgggcaaaaatggcattgttttcaacaactgatatggactgcctcataattgctatagccttagcaatctatactggccataaaggcaagccaaagggaactgttatgactccagagagttaccattgcctgtctattaggccaagttgtaccccaaccccaaaatgacagatgatttgctacacagtgcccaagagaaggaagaataataaaagaaaagccgtgttctcattctgtgcatagttttgcctcacttcgtacagtaagtccaggagtcttattttccaaagtaaaaatggtgaaatttgtctttaaacactgcttctaaatgtgttggttagatgcttcatttctacaattaaacacctacctactggcttcagcaccaggtatttaggccatcctggcctagttccactgactattccagtgtctataaaacaccttcaccaagcatgagaaacaaacacagactttattttctacctcatctgtcttgcatttccttgtgcttaatactgtgacatttaagtggcagtgacacaatcagcaaacctagtgaaggatgagtctatgtaaaggcaaccatgtttgcgggcagagaatatcaactttatacgtacctaaatgactgctgtgtgcacagcagccaagcccaataaatgttaaatcacaaaactcacactataagctgaaagtgcctttaggtgtgtgaattccagtttcatgttgcaaagctacctaatattctaaggttgtcgggggagatatggaaattgagtctatagtagagagaaaagttctacaccaactccagaccttatcagtggtcaatataccaacccaacaaaagcaggttgcattctaccacggctattcattacaaataattttacttatattcagtgccaatgcccagccttctctagtccctgttctagctttacttttcttcattgcactaatcgccacttaacatgtgcatattttacttatttttttgtgggccctcattcccctcaaccaaaatgcaaactaagaagacagagatttttatcagttttattcattactgtatcccaagaagctaggatacaggggattctctctgagattatttgctggcaaatgaatgagattcttggcatttgctaggcactgttcctttcgctttccatgaattagaagaaggcaacataaatgaatagccaaaagcttgggcctcagagtgagataacctaagtcccaaaccttatgaagtgtttatcttgggcaagtctcttaaactctctgtgtcccaagtggctacctctaaaagggagatgataaaaaggacactacataaaagggctactatgaaatgtaatgagattataaatatactgtaagatgctttgcatagttcctggccacacagtaactaaacaacaaatgttagccattatttttattttctttctattatttttataattattaactattaaaataaaggtaggaactattatcattctctttctacaattgacggtacaaagaatgcttctgcttgaagttgcaaaatgttacaaatggttaaaaaaacattagagaaagagagcaggagagaaggaagagtaagaagcgttacaggaagaatcaagagatactagcctagaaataaaaagactcatcctggagaacttggttaaggtgggttctgtgagcatgtgggagcctggtaggtccagaatagacacttcttatagcagatctagaactggcaacgaactgtagtaagccaaagagtgaggtaggacctaacagattggactaggaatccaacctacatgacctagatttctgattatctggctccacttcctttaccgtcacagagagtaaggtctccagttcctcccctgtactagaatgctcccagacaacctaggtgattagtgagagtttaagttctctactctgaaggacttgggttcagacacaactcaatcacttataagcttagtgaccttggactgacccttaatttcttcatttgcaaaatgaggaaactaactgcatcttatcccatagggttgccatgaagataaaatgagatggctcccaacaagtactggatgctgtctggggggtaaaggaagctttcaataatcacataaacagaagtagcattcaacctggctgagcaaatgctttagataaaatcgaagttctttctcttccctgccctgactccccagaagagaataatatatggtataagcaaatccaaaaatacccgctaaaggaagttaacaatcagcaactatcattcttaatgtcttgggcaaatcagcatacttttcaaatacaaaaaacacaaacaaacaaacaaacaaataacacctcaaataattaagtactttatgaaaataagtcaaagtttctttagaaactttgtcttaagaatcagacaaaggccagcccaccacctatgtcatggaggggtcataaggaaagagaatgaagaaagagaaaaagaaaaaggggtgaaattctaatatttaacatctccaggcacacgccccagcctctcacgcagccctacctaccacaaccaaccaccacatttgatgcttgaaatctacctaaatcaaatcgatatttgccttagcactttccaaatatctaggcttcccctagaaatacttacaagggagatgatattcagtttagactcaaaggccagttgtttcaaatgtcaagtgaaataatatctcctcctccttcatcgtgctcataaacttatacaacaaagacatcctgaccctcagaggtcagagaactcaagcaagagaacgagaatgcaagatatctccaaggttattttggaactaggcatggcttgaagacacatctaatggtgaagggcttttaattgagatgctgcacaccacctggttggggttggggtctctgggtgggtggatcaggcagtgggggacagtgaaaactggtgaaattatcttggaatgtgcttttatccatagagcttggatatacccttccttagctgatcagagagggcccgggaaccaaaagacattaagatcttagaatgcattttctactctctcattttatagatagcacaactgagtcccagataaaataaaagtgtttttcccaatatcatacatctgctgatggtcctgacttagccactaggcaagtcccccagactccagcctgcggttgcttccatctatcaaggcctcttttcaagctacttggaaggctctcctagcaaagatgactacaatttatgctcccttcacaacattttgattgatttttggtggaaaagtaggcatccctgaagcatttctttaaaataaatccagcctgccaaaccagcactgatgtacaaccctagtagaagaatccaccattggccacaataatagcaaaaagggtaatgagaaataaacgtatttaagtttacaagcctcgaagaggttatcacacacaatgacaggaatctttgtgtcaggactgaacaagtaaccctgatttaactttacattttgatagagtcagccgcgttgcagtcattgtttcgtctaacaattaaaagcggaatttgaaactattcctgtccatagttccccttaaaaaatctaaagcaaagagattctctcatgccaggattgaatgaatttataattatctatctgtagctccaggacaaaagacttaaacacaaaaaagccaaataaaccaaggacaaatttctgatagttctagttaccctgcctattaaatgatagacacattaaaagaaagagagtgatatttggaatattcagaagttggtggtccatttctcatgctttgttttagtatcactctttcttagacgaaagacagtcatgaagttgtttgtgaagactctcatcagacaagagtacagtgttaataaatgcatttagcaagcatttactatgtgccaaacactatgctatgtatgggctgtcatgtacaatctcagttcatcctcataataaacctgtgggtaagtattattgctaatttcagtttaaagaaattagcaataatacttgaggaaactgaggcctaaaacaggcaaagtaacttactccagttgcatggctaataacttgcaatttggactcaaattccaaagcctgtatgtttttactcgctaaagtttgtggtcttggccagcaaatttcaagaaggcctgtcataaagccgtgctgagagggccaccttacatgccaattacaaccttatttaaaatttaaagtacgttatttcttcctgaaatggaaaataaaccattagatatctacaatattactatgctttagagtcccaaaatcactcatgtataattagttatacccatgatgtaaatattttaaatattattaaatgccttactataaatattagaggctggaatagttaaacagccaattaactagctagtggccatctctttacctctcagcatttctactctgttatctgaaacaacccatacaagtatctaagtagaagtttagaaacaacggggctttggggagctgctgaggagggacactttgcaacctccaaaattactgcaaaactatgtgcatatgcctatccaatagtttttcagtaattttggaggtttcaaagtgtccctcctgcccagctccccaaagcccatacagaaacctatttgagaagctttcgatctaagaaatgggatctgggaccttaaaaaaaggctaaaactcaatggtctggatatttgtgagactatattccaaccagtacaccaggttactgcttcccagactctgttcttcaaaagacaatgtgtcaagtttccaaattatggggggcaagggtagtgaaaagtgagtgtgaacctaacagacaactaactgaatacttccctctgcatctggaggcttaggaattcagcagacagacataagcaaaccattctgtgaaattgttagggtgctattctttctgacattgtgttggtttcctattgaacatctgaagactgttttaacatgtgtgcctaaaaatgtcacactgaggctgagagagcacagagccaggggccacccagactttcaaatcagctctcagaagcagccagggaaattccaaccttggtcttgtggtcctcaagaactacagaagcatggcagaattttagattcacaggttgtttgtacagttagtgcatttatacctaactcctcaaagccagagatattttttataactcagcattgccctcattgctttcttatcacatattttgcatgtgtttccatctccaagattcagggaaaacaagatacttagttgggaatgtctagagtggagaccttataaaaattacttgacagacttgggagaggaaagcattttgcaaaacaccagctatgagaataaacaattttagagaatcccttggggacattttttttcctatggatcccaaaatcttttttaaatagaaacatctcaggcaggggtaagaaattattggttaagcccatttagaacgtgtacgctgtcatggaacattcctatcaatggggcacattgaaactctacactaagatatggtggggctgtggtgctttactggataaataagaaggggtttggtcgctatactcccaccctgcccataaatgagtaagcccgtgtgacaagagtacatgttttcgaaaagaaagaaactgtgaaactgagcgtcaccatcctgccacataaaaagcaacagaaatgagaattaaattcagcactttcttaatgggagactgaggaaatctgggagatgaaacagtagctcttctccagtccttcccagcataataaggtcagctgacaacactgttcgacagagaagacttaatgtgtctgacagatggcaaatacaccatattgacttttcttcctaatttaacaaatttgaatcttttgtcaattttctttccccagtgaaaagatattctaaaacaccacttaagcttacattgctcttttccccctctccctcttacacattaagtttgacactatctaaagaaactgaagctaactcactaaattaactcacctttccagctcttcatgatcatcacaaatttgggcattggcatgaatgttaattcctcatctctgccaactgtaaggcagatactcacttcaggccagaggaaggtggctgaatggacaacaaggattccttgaactcttaaaaataacacacaaaagtgtgcatctatattcttcatacttcaaaactatgtatctatgttcttcaagagtccccagttttgcccagttcctgaaggtataatgcctctggctttagctataggttgttataattagccctcattctacagtttctaaccggactttggaattttatggggtttgtctatataagatggatgggatgatagcagagaagagcttcaaactagtggagctcctggatcacaaagctgtgtaagtcatcccaagtgtgactcaagttcagcctggagaagccatggccaggccaaggatagcttgtcccacaaggaggcaaggggccgtttcccaccactgcctcatcccttccaccatgtgaggacacagggagaagatagcatctatgaaccagaaagtgggcattcaccagacaacaaagctgccagtgtcttgatcttgaacttcccagcctcaagaatgtgagaaaaaaatgttggtcgtttataagccacccagtttgtggtattaccttagagcatcccaaatgaactaaactactgttttcataatttacaatgtgtcctaaaattaattataatcctaactatgaacatgaaattctgccaatgtgaaaataacattagtttctcttgacaacctttgtagttatgttacccaaaagtatctatagacaaagcatctgaagattttagtggttattcactattataaacaacaaccacaaaaaacccaccaccaacaaaaaaaacactgggtccatggagaaataagtttgaaaaatatttcattatgcaaagtaaaatggatttattacaaaaaccttcttagagcatctcatggaaatggagtttagaagaatactatgctttagattattcctgaatccagacacattttttttaaattttaactcaaaggattaaaatttccacacttggaatgcccctgtatgaggaagaactgaacgctgtcctgtcttgtctaagtttcagagtaatccctatgtttctagctgattagctggtttcataaggcaaagggccttctgaaaatgggccattgcttctgtgacaaattcaatatccaaattctattgctgcccttgaactgtgctctctgatttcctgctgcaaaaatgtaggccatcagtggggacgtgaaaaatttgttcattacacacagattcccacagtggcagtgcctggccacattaccgaacctatagataacatcacagcacctgacatccagcccacatttcctcagcctcagagtaaagaacataccacggtgcccgcacattaacgcagagagatgcccttgataattaacagttcttatggagtctctcgaatgctaaatggtcaaatagagaagttaaacacacataaaacatttaatgtgaaatgaggcaaatatgccaaattaacctgaaatgcacacaaaagcctttcagctctggaatcgatattaatcattttctggaattcaagaaaaagtctgatgtggttaatttaaaattgtattttatgatagagaacaaaaatatcccacaggattcaaggtatcagtttacactactgccactcctttttgctgccagggtcagcaaaaagaaaaaaaaaattattgatctggtattaaaaatcagttgacttcacttctttctgaacaggtattctttgaccactaagcactggctagtcttacctctctctagtgacaacatgaagagataaatagactattcaaacagagctcttcgcgttacattagctgaataaatagtgatgtatggtctcttttctcaagcactgccttagcttgtgaagatgagagtgaggaagatggggcttatgaatcctatttgaatatttaaataaacacaaaataacatccctgaagatggttgtttaagtggaaaaagaaggtatgaaaatctgtcttttaattgtagcttttggggcaacaaaaaatcccccaagaaacttttgagattccagtgtcaagtgaaatcacagaagaaaaaaaaaattaatttgtggttttataagcagtatccagaggaaatgggatgccagtcccacagggttttcaaaggctgcaaagctagcacaaaccaattcacctaaagtgaagtatattatcaataactaactgtgatcactttttggccttccagctaagatcaagtgtaataactaactttactttgggaatatttcacaatgaatttttgccctctttaatctgctttaagatttctgtgctcaatttccggtatatgccgtacttgcagaaagggatgaagttctgagctaggttaagtgcttgtggctaactacaaatgtgttaacacaatgtaattaggtcatcaaacagcatcatgtttattaggtaccaatagataaaaaaagggagcaggcctagaccagcacatcagccccagtccctactgtcttggaactgggattctgagacatctccgtggcttctacacattactggcataattactaaatccaaagttttctatttgtaaattagagattctagcaaggaaaagatgaagtcctatgcatcgtgcattagccaggattctttttttgattttttttttcattctgttgcccaggctggagcacaatgccactatctcagctcactgcaacccccacctccctggctcaagcgatcctcccacctcagtcttccaagtagctgggactagaggcatgtgccaccatgcccagctaatatttgtattttttgtagacatggggtttggctacgttgcccaggctggcctcaaactcctgagctcaagcagtcggcccacctcagtctcccaaagtgctaggattagaggtatgtgccaccactcccagcaggtcaggactcttttggaacaaaaagaaggggtatatttattggttcacataaacacatcctcaggaatgttaaggcagaaccagtacagtcctaccttcctattggcagttttactttctatggtttcaagttgcctacaatcaactatggcctgaaaataagtgactagagtacaatattctgagagcaagaaaaagaccacaattattaactttgtactacaatatattggtatagttgtactattttattagtagtaattgatctcttactgtgtctaatttataaattaaacttcatcgtaactatgtacatataggaaaaaacagtacaaacagaatttggtaccatctgcagttttaggcatccgctggggtcttagaatgtattccctttagataaggcggactaatgtatagtcctttccctctccagtgttggcttcattctctcagaataaagatgacaacctggctgtggaaggtggcctcaggaagctcccaacctagtaatcagagaagaatgagaggattgccccattagtaccagaaaatccctatattagcaaagacagggacctgatttggtcaagtctccattcctgtattacccctgtggccaaaggggattgagtaactataattaatccagtcatgagggaggaagagttgctgcatagaccaaaaacaagagcctctacgtactgaagtgatagggcaaagaacatatatttacgaattataaccaagtctaaattgtattcgaattcctagaagatcaatgttacttaactttcctgtgaataatactcttgcctcttactaagtagcacactatccctaatattccaaggtgaaactcagtcactgagaattgggcatgctgcaccagactgttttcccagtagtagcaggagatatgctgaacctcatattctttctctttactgctttattatcattaatgccttagactgaatttctccagaactgatcatgagacaggaatctgagtacaaatggattatttgagagatgggcccaggaagcaccattaggggagaagtggaagtaagacaggggaaaaaagaaatctactacaagaaacatttataagaatattagtgcttcaagcaattggggctcaaatccactggggggggctctggaagacagcgtggaacatgctaccctctgagttttcgcacttacgacataggaagctggggaatttatcctcaaattcccactggtattggctaaacattgttcctaaagtcaataattcctgacactttaggcctacactctacaccagcaagagaaagccccagagtgcagagtaaaaggcatgtgaaatagaataaccttagcacatatgagaagggtgagtcccagagaatggaaccaaggcacacagccttggctaataccagtaacacacacttatgaaaatgtgccttcatttattcaaatacttaccaagctcctattaagtttgagttttcttctagatgatgggcatacactgagggacaaaacaaagattattgtcttatttaatacccagcacaactgggcggggcaggggcagattccaggggctacatgtcataatcctcttcacaacagcaacttcaaatgtggtccctaatcttaagagtagcagcagggtcagcagtattgggcttcaccattactaagccaggtgtgttgaggtctatgatccagtaatgaacctgaatcagaaatggaatctcagataggtattggaaaagtgggagagttcccatcgtaggacagtgagttacattttgtttaggaaactcttcagggacatcttctctgtggtggcttgtgtccagaggcactgcagagttgcctgctctaactcttgacagttgagtggggcatgcagcttctggacatggaaaggactaaagttaatttgcccatctggggattgaactggcatcagtgacttcaaatgtgccctgcagagcccaaatgatctccattacaaacacagaatgctccgccttccaaatgccacagaattccattttatctgcactggcagggtaaggcagagtatttgccaaaactccagacatagggggttatttgtaaaaccttagagtattatcaggtgttgctttcaataaaccattacacttgtatagaaagtaacaaactacgtggtctaaggaccagttatccctattccaaaaaataaagtgtaagtaagtaaagcaattttacattgaatcttgaacatctatgtacataatttagaatttgctaaaaggtaattttatctgtgctgattatctttaccatttggcatttcccatctcagggcaatgagtacaacttcacaagtccagctccgcttagctgtgagtactcaatttcactaaagacttaaacagaaaattaaaaatctgtgagaattgggatgagtcctgtctgtcttaaagcagggtgagcaaatatatgtggcacatgcccttaagagacattattaattgatcacctctcactttcacactgagcctaggctgaaccttagaatccgtcacagcgcaggtgtccactcagtcatgactggccttccagaactgggtactggaaatgaaacctacttgacacttaggatacatttatagagcctggtcccctcagtactatactcccctctcacaaacagagagagagaaaaaaaagaggaagaggagagcagagaaaggatgggggaaggaatgagaggaagaaaaaaaactctgaaccaagtatcacttcctttgcggtctgcacatgtcaaggaatactccattttaagcatattataacggcaaaaagaaaaaagcactatcaatagcggttcacactttatggctgctcaccctgaaactgtagcagctaactttcttgggaaaactcagacagactcattctttccaaaaacaaggaaagaagaaaaagaatttcccacatccttaagataactgagaagctctcagtaggagtaaactgtccaaataaaattcaacggcaccccctttggaaggatagttaagaaacaccacatgtacaaagaaggattaagattccaaatactgtcttttctccaactcgatttttccttcttgtgcccttacttctcaaacagttattccctttgctatatcacccagaagtctgtgattggatctcccttggactccaaagggctctgggtatgagaaagtagtccaaaatatatatatatatatatatatatatatatatatatatatatacacacacacacacacacacacacacacatatatacacacacacacacacacacacatatatatgtgtacatatatgtctaggatttactatagaaaatttttaaaatatttttatgtatttatatttataatatatttacatatttagttttatatatatttatataaatatatacatatatttatataaatatatacatatatttatatatatataaatatatttatataaatatataaatatatatatataaatatattttgtattatatattaaaatatatacgtatatatgtgtatatatgtataggatttactatagaaaaatatttcatatttttatatattcatatattttatattatatattaaaaatatatgtacgtatgtataggatttatatacatatatgtatatatgtataggatttactatagaaaaatattttatattttatatatattaaaaaataaaaaaataaaaatataaaatatataaaatatataaaaatataaaatatatctatatatatctatattatatatagatatgaagatataaaaaatctatatattttatatagatataaaatatataattatataaataatatagacataaaaatatatatttatatattttttctataggaaatcctatatatatttatttatttatttaggactgcttttcctgaaactctgtaaaagttttcatcatactagctatttcttgtgatgagccagatcatcattcacctggtataaatgagcttggctgtgaacacggttagaaattagagccaaggatgatctattagttcatcgtgtgtgtctcatgggacaaaagcaaatgtgtttctctaaagagttttcttgaatggtttcccaagtccaacttgaaatcacattcacaatcttgtcattttcctctttcttgcagcacaccagtaattagatgttttaacacgtcatggcaatgatatctaacatgaaggcaaactgtattaagacacagcatcacccagttttatactgtaagctcatttccaaacattatttgtttttataaatttgagcgaggctgactctttcctctctgcctttaattaataaggaaagcttaatatgcacttttttttcatcaatctggcactaaaaatcctgaattccttttgtagtaatttgaaagaagagtttggggctattaggagaaattcacattaggcatttccctacatggcctacttatgtttttcaaagtgaagggatatttcaaggaaagaaagacttggggtactagagatgtctgccccatctaaagtcttatttttctatttcctatatcaagaagccttaggtacattttagtaacatagcttgaaatatattttgaaaaggggaacaagacgtaacctgacccactacagaaaaatgcctcatgtagatccttgaatgaatttatgactgtaaaagtccctctcttttgtttcctgggtaattatttcacacatttgggaggtttatagggaatgcgtatcagcttttcaagtaaaaagtgtgagtctctgactcttcctggaaatctggaagcaacagagaatgagaaattctcaggcagcctccaaaattgagcaagagatactgcaggtcaccttcagtgctgaatattccaaagttaacttcgttaaaaatgcacaaacaacctgataaaatatctgattttaccttttaaaagtaggattaaaaatttaggaagcttcgtgacttactctcgcatctctctttgatatttctttgtttggtatttctctcacctcttatgccctggtggagtctattgttggtttatgtgtaacatgatcgaataaagcaaaattgtaaacattttctttttaaataaatagacttttacctgaacattataatcacagtatctcattcatccattcactcattcattcatccatctattcattcattcacccattcatttattcactcaggtattttctgagttctttctgtgtatctggcgctcctctaagcagtggggatacacatgtcccctgttctcatgagcttacagtctcctggtgaaggattttaatcaaatcatcacacttgtgcctaagggtttcaaactgagataaggatctcaaaataaaggagcaaacacccgaaggatcaaggacgacttccctgtgggggtggtccctgagccaagggcttcagcagaagcagaggttaagtaagtaggaagtaggacaagccctccaagataggggaatgcagttagggcctcgagcaggaggaaacaggggcaaagctctgaaagtaaaggacaggtagtatttgctgagctactctaagacagattctcccacctatgctgacagcatgcacaatttcagctcaatgaatacaaatgaatgctctaagtattttttagattctctagattatgcacattgaggagcagtttggggtagggatgatggaggtctggccattagactcaggctttaaagaggttctgggaaggggagccaatctgaagtacctggaaattggaaaaaatagatgaacagtgattttatctggcttccaatggcagataaatttcctttcgggaaaggcagatattctcatttcaagccaggctcctctgccctcactttagcatatgaggaaactgagctcttgagttcctggaaacctttgagaatatggagacagccttttcactaggtcagtttagcttcagagggaatgagatggctgacttcccccacacattaggactttcattccaaccctcggccagcacctagggaacaaagcaaggccccagctttagttctacttaaagtgagacactgcttgctctttcacactcaggttaacattcactccaacaatgagttcagaagtgaccatgggaagacaagaggctttccaaataactacctcaccatggcacagggtctctgagggctgggcatgttagagtctgagatataaaacacagtataaagaacgttctattttgcaaaacaatcacattctacaatctatacctaagtaacaggaagagagcagatctcattatgtcccttctacaagaagaacatctgcattgagttgggtgtcttcatagggagtcattctcagggaacgtgaagcttcctccccatcaccctgacctcccttcccctgtaaatttccacattgattgattgtaaacaaattgtgttcatctgcccagattccattatatcaaaaagacatactcctctccacaaatatcggagatagacagacagataaagaggattactttccagtagcaggggttcctccccactcttcctccacagagaactttatttctagtacatagtagaagaaagagtcaagagacggatgagaagacaaactcagcaaagccttatttttatgctgctgttgtttttaacctttagtgggaagtaataggagacctcatactttatgaagcctttttgtatctggtggtagtttttaaaaagaccatcagctaaaatataaatataaatttaaccatggatgattgtaatttcctgcattatatttttatgtattttcgaaaagtatctgtaatgagcgagtatcatctctgtaatcagaaaagaaactatgaaaatatccccagtgagatctgtgtttgctcacagggcactatttggcatgatgagagtgaggggaatgatctgaatgttttcagtgccaagcaccatgttggcctcaatcggtagcaattctaattctttttcctgtggatttgtatcagttgctggttcatttaaatcagctattaaaggaataaacatgaatcttaaaaatacatttagagaaagtatattgttctaaattaagcaagcagttggcatttcaaatcatatggaagcagatgaggggaacccgctctcaccagatctcaatccactttgcaaactgcttactccttaacttggctccctaattagggcattttatctttgtgagcatttaccattactgcatcatgataactcttggctagtattctgtgaagaaataattaataataatccacaccagccaaaagtagatagagcaacatgagcaaagaactaggttggtgtgatgtggctcaataaccacttggggaaaaacaatgagagggtttttattgaccaaagtggtttaacaaatgacacttaagtgatctactggcattttagaacagaggcaagactgctcactcattaagtcattttaaaaatagtcattatagagcttttgccataaatcaagaacaaaagattccaggaaataattttttataattcataaacacatagtaatgtggaaagaaggactctatagagttgaacagggttatcaattacattttccagttgtctatcctagagacaacattccttccgtgagttcaaaccttaaacatccagatgaggtattgtgggtaaacttgaggattgacacacttcagcagactaccagctccatgagatcaagggccacatctgttttatttagcgagaagcagaattaggccatgtgtgacagtgggtgttactcagcaggtgctcagtgaataatgaatggattaatgacattgtatagtagtgtctgactttgcaaacagaaaatcacagcctttgtgaatgtaaatttacacagtaaacccaataccatatagacttttagtgatattttggtatttagaaaaaagactaagatcttctccaggtagaaaggtattttgtcaagtatttgctgtgtgtgtttgacttgttttggcctgcaatgtaaatgatcctgatagacatctagttctactgggttccacagcacttctttagccagtggggtcttgtattcaacttgtatttatcacgtccttctaatttcacttgtctcaccctggctgttattataatcccaaacagacagatacattagtaccccaggcttaagtctcatcctattcattgctatcgggttattctctaggaagcatctttcttttcatcttagtcccttcttccttccttccatcagtcctgaatgctttctgagtcaaattccgagagcagaccctggctcctgaatctttttatgctcagaccctgcaactgctcaacagtcgttgtctccctgatcctcttcacacagccatatgtcggccaagatgctcaactcactactgccacctttatacctaggctcatgccagtccctttgcagagaaagagaaacacagagggagagagaaacacagagtcttgagtccctggatcaagccatacctgaagtcagaaacttcccttgaactctttaattatgtgacccaataaatcatccatttactgtagccagtttgggttttctgacacttgcaactgaaagagtctttaacgtatgcagggaagaggagatgaggaagagaggaacataaaaatgaagtaaaacgaaacagaggaagaaaacaatgaaagatttgtccaaggctgtagaactaaacagtattggataagaatatagaacatgaagcccagagcccaagactctttcccctactacttcccttcagaaattagtactattactcattgccacacattgttactttaaacctaaccaaatgagaagtgacctgccatcaagctcccgcaggtttaagacatatatttgtcctgagtaacttatattgttttcctggcgtagtacatttaagaattacttttacaattaagctgcccaaggggtctatagatgcccgttttaatttaaataaatactaatgctaaaatcaatttgtaggatatttcaattggaccgataagtacagtcttcactaaatccaaagtatttccctattagcgcatctttagaagcgtataccaacaacacatcaggattttcagaaacctgctacaaatacattactcccagagactggatcaaacagctgatgatcaaaacataaggcaaaaactagtatttcatctttgaattcggagtacctgatttctactaaatattgattagagtttttcccataagagatcctgctttgtgcctccttaattttcttggtttcaatagtgctttgtgcagagaacagcagaagtaaggcagaggatacagctgtcatctgtgccacagacattgacatgcagcttagtcacagaacagagagaacacgtgaaagtcaccatcacaccctcgcaacagtgtcagtgtaaagactcaggttccagatatgaagacaggactgaaaatgcttctggctacaatgaaatgaatctaccacacacttgccaactttattcaaactgatgatatttttctttaaacaatggatttagttattctacccgtaagaagtccaggtcgttaatgaaatgataattttctacaaactaaaaacaaacatatctcatcctactaatggttcctgcctctccaatatttcacttaggccatctcccttttctcttctggtagaacaacttcaataggtaagaaagttttcttacatccgggaaatttctttaaccaccaaaatccatggtgtttgcttttcatcttcaactcactccttggtcgttacgacatgttgcctcctatttctggttatctatgttagtttcctgctcttcctacagaattgcaaccccggaaagagaggtactgagtctcacacaccttcttcacctggagcttgtaacaacatcctacaaagcaagtaatcaacatgtgttttacagagaaaactggttatccctggactgtattaaaacagtggtatgggtactctaaaataacaccaatgtgagtgtagaatgcatttctcatttaagagaggtgttcattcagcctgaggatgggagaatttacgaaacctcaaaccccaattggcaaacagcctctctaccttcccagtttacaaaaccctacctgagagaaggtgtcttctctcaaatgaagacttccagatcctgttctccacagacaattaaatgtggtttaaaagttgctgctgggagctgaggttattacccactttctgatgaggccggcgccaccaaaaccagcctgtgggagctgatttcactaggactcccccaacattttcttgatgttggaggtgtaacggggtctcagttcctgttcaactctgcctctgactggattctaggtcttgagcaagtcactgcttccctctgaacctcagttaacctcatctttaacatggggataaaattcctggcaccatagctacctcactcaatgctggggaaaattaataatattgatagtgttaataattaaataatagctaacatgcactgagttataccatattctaggcactgtgataagtcccatacctcccttaactcttactattctcataactactctatgacaccaagcaccatcattatgtctcttttacagatgaggaaagtgaagctcagagatgttaaataacttgtccaggatcacagagctaggaagaagcagagcaatatttgaacactggcattgtgggttacaaagcattactcccagaatactgccttacaaaaataagataagccatgtgacacaaaaatcttcacaaactgcaaaatattaagccactgtaaagtactgttaccatcaatgcaaatagatgctcattacatttattgtaaaaagcaggtaaccaccaacccgtttagggaaggtgcataaacctctgtcagcaatactcaatccatctgcagagaaacaattagaactgcattagcacataatcacagaagaagttctcttgacaccatttctgccaaagaactcattcttccctggaatttgaaaaggcaaaaagaaaaaaatcccatgccgcatctgacaataggaacaaactcttcttgcagctctggtaatgcaacacttctgaaagaacaagttaaggaacgtacttccactgccctcattagctgacaacctctgtggggactgcaaaccagccacacattcaaaacaaatcccagggaagaaatcacaccacaaagcctgtttctatttgcaagtaaaatgacggccccaagtgtctttccataaagctgtgtggtaccaaatccaaagcccaaactggttacaaagggtcgccattgataagacatggcatttcaggtccacccaccatgggccaaggaggtataaagctcagaacgtgacatgcaatttttaagccctcctttcaccttgtctatgcactaagttactttgacgccacacctgtttctattctgcctggaagccctgtctgcacaacagatggcagagtgtttgcctaacaaatgttcttgtgggtcagtataagaaggtggtggtggggattgttgtgggtacgaaaggagagaggctctgctagagcagcaaagaaccatcgatctccaacttagctagggaaacttcccacccaatgagggtctgggtatgtctgagctctgaatgttctcacctctgttcatcccttctgacaatcttgtccaggatagtacaaatctgctgctgcaaccggaaattacaaagaaaatctgatgtaggcatttagaaaaaaaaaacaacagaacaaaaccttatcaaatttaaaagttaacttcaaattcaattctaactctatctccaacttagctctcttgaatctaactgaagattcaactttcttaactctaaacttaacccttgaatcccaactcctagctttcacctctcaagtgtcttaactctaacttaaagtcaaacttagtctcttgaggaggtaattaaacttcaacaactaattggaatgagttcttgtgaactgagagcttggcttatcaacacatctggtcttcagaggttaagaaaaaactcactttctgttattgtaaacttaacaccagagtaatgttttatttcagctatgatggtaatattttttaaattatgctattatccacttaaaaaatccatgatgtaaggtataaagtaacataatgctccttgatggtgaaagcacatcttaggcaccatgctttggagaaaaactgtggatctggagggaatctcctcctcccaccctaaaccacacatacctaaaccacacacagcaccgggtatacctcagtcttcaacataaagaaccaactcggcacgttccatttcatttgactcacttgcttagatagcttaggaaaccaatctgctcaacattagtaagtctgggcccattaaaaggggactgacactaaactgaaatccatttcatctcttctccagggttttcctcggactctctgatcagcctttccttcacacaggggtgaggccaaaactactatagatgaagaagaagagagtgagatgatgttctttttgagggccaggatgacactggctttgtccagtgttttcatcacagaaattgaagtgggcatgtagtaggttctcaaaaaaacaaaacaaaactggtgaataaagacgatgtgtgctaagcactaagcagagacctccccattcgtgctcttatttaatactcacaaaatcctaacagcagggggtattattattccaattttgcaaccaaggaaacacatgcaaatagctaacagtggacagcatcagatttaaatacttaaagcatgcatttcccatgagtgagagagacattttgcaaacatgggtagaatgtggctttgtgacttgcctcaagattcaccccatcaatttaggcaaaaaatacaatcttccctgactatttagttggaagataacaagtcagggaaattcagtctagcagtccatgggtaagcctcaggggaataggaggcccctgaaattaaatgcgacattttgtgtgtatgtgaatttttccatggaaaaagtctgcagctttcgaatacttgaaagattctatggtcctcccagcccacaaaatttaatgacttagctgcttttaattaaagttatgcttctaattctcatccccaaagagtccaaagggctccagacaccctttgtatgcctactgaaagaaaaatgattagcatgaaagcctggtgggtattagacatgagaatagtcaaacaccttaggtatggaaagcacccacatagatcattacttaacgaagaaaagtaattgagaatgtattccattgctagcatttgtccacaatgagattgagaagccattctattgctgaccagatggtcctgaggatagtgaaatgacagaacccctgtatcactcatcagattcactgctcttcaaaatatgaaaaagaaccaacaaaatcctcattatgacagtgcctacaaacaagatccttctgaccatttcacattctgcaaacttcatctgcaataagaatgtccagacctgaggctctatacttggtgaaaccatgctcatgttcaaaaagcatttattgagagcctactatattctaagtaccgcaataaatacttgttcctataccatctggatgccctcatgtgattctaggcaacacgtttaaaagagaacagtcaccaaatagagaaccctgagatgggaggaaccagtttgggaaagggataaaaatcatgccatgtacacagccaaaggcattgatgattctttaaagggaaagtaatacattttctttcaacttctacaaagtttctaggtagaagaagaaatagagaatcaatccaaattgccagagaagtctgaaagaggaccacaaggtaaatatttcagagaagcaaagtgttggttcacaataataaaaagaaagaaaggaaatgaaaaagcaaactattatagctggggttattcaacaatggaataagacagctggtaaaatgttagtcgttgctggaggaatttgaaatgcatttatatgttaaaagcactaaagctaaaactataaaaccaaaagatgggttagtacaagatgattgtcctaaaatacaaagaaacacacattgtcagtatgtgaaccttaaaaactaatgttggttattctgtttaaagagaagaatgtgatgttcacaaatcaacttatcacaaattacatgcttactctagtaatgtaatgaccttgggagctgactcatagtcttccttgacctaatgagcatgctgagtataatcaattaggtttgcaattaaaattgcaatttatctaacacccccctctacccccacctttttataaggctcaggagacagtggggtgataaatataagcccttctgctgtggctatcttttattttttaagcatttctattacgtataatttattaaaccttaaatttcttccctatttgtaagtttcagcaaaatttagtcaggtttcaacacagggtatcaagggataattaggacagttagcagtaatttatcatttctcagctgggttttcatgctttcgctgactgcccgtagaaatctgttagccacttctacacagatcactatgaaatctgctttatctttgtgcaaattgcttttctattttcctaaagtgagctgaaagatgagccaatcgactcctgaaaatctagccaccggtgtgcttgtcatcagagtgcagctgaggccagggccgcagatgaagggctacagtggctaatggatgatgcaatgccatgagaggcttttttccagcctgctgcgggttagaaatttaaaccaggcagcccgacttcaggttagatcttcacaaaatatgcccaggaatctatgaacatgccaatacacattttatggagcaaatattgcctagtaagccaccagagaggaaaagcctagaaaaggcagagacactagtactataccacttccactgaaaagagggattttatgaagcctgaaccaaaaagggaggacctcgtgttctttagagagattcatttactagatggtgaaaaatgaatgcttcgggtaatttcattttgaattgatttatttctaaatggggggaaactgacacttggtgaagaaagtaacaagtggttctctggaaagagccagccagtctcaggtataatccaattattccaacacaggaaataaggacacagagggaagggtggaaggtcacctgagaaagtcattccttgcaatgaataccttcctgtccccttccctacagactctcagagaagtataaactgacccatatttccagtttatttctgacacctaaacctaatcaaagtccactatttagaaatccaatagttattcgcaattagactgcacggcaaattaaatcataaatttctctatctcagccctggttgtcacattcctaaaacacaacttgcctccctccggcactttatttaaatctctgaggccgggctccaaagcaagttatggatttgataatttgctaatgtggccacagtaattgttttgagccatatttatgattttattggatcttacaacaatcaataataatccattgatgtccctgactcgggttttctcgcagtcgacaaatggggcagcagattcatttttaatgtactcacttagcactccctccctgggagagagagccctgcatattttaaaaaagggcaagaaatgaatggcactggtacacatactttactgtgaaaaactagctgcaggataagatttaatgctaaaaagaaaggagagaatagactaacagggcccattttgtgcagcaccaccatcgttaaagttaatggaattaccgtgtggtcacgcactagagggaacctattggaagttaagctcttctagggccattgattcacagactttcattcaaagattcccactagcatgtgatgagtattgcagatatgcagaggcactttagaaactgtttactcaaactgccagttaagcatattaagaaacaacaataactgaatattttagagtggatgatctagtggaacgtgtcttctgttagacatagtaaaaacttcaactccgactggcttaaacaatagaggactttattggtcacctaatttttttcaggctggagtgcagtggtgcaatttcagctcgctgcaccctctgccgcctcccaggttcaagtgattcttgtgcctcagcctcccaagtagctgggattacaggggtgtgccaccacacctggctaatttttgtagttttagtagagacagggtttcaccatgttggacaggctggtcttcaactcctgacctcaggtaatccgcccacctcagcttcccaaagtgctgggattacaggtgtgagccactgttcctggccagatcacctaatttaaatgtctggaagtaatgcaggcttcaagtctggttaattcaacaatccaataatgtcacctagtgtccagcttctttctgtctctgccatgtcagcctcagcatctgttttgctctgaggcatgttgccctagaaaatataagatggctgctagaagctgtcagttacctgctttcttgttcataagcagtagtggagaaaacagcccatccacaactaatgcatctaagtcctccatgatgatgggactccgatcctttagagtgtaggattcctaaagtcaagggaatcctacactctaaatagcttaggaaaggattaatgaaagtcattactgtggcagagacaactgacttagactgggatgggcaaattatggccctcaggccaaatttggcccaccatctgcttttacaaataaagttttattggaatacggccatgcttatttgtgacaattcattttcatatattctatggcttcttttgtgctgtaaagtcagatacataattatgacaaagaccatctggccctcacagcctaaaatgtttactatctggccttttacaaaagaagtctgccaacccctggtgtgtaccaaacaaggtctgcacctggagctaaagatgagttcaaacccatcctaattttgtggctactaaatcaagagggagggtaggaagaatgctagagggacaaccacagtgcctaagatagacatgagagaaaatccttcaagtctagaaaaatgggcttagaaactaaaaaaaaaaacaatttaggaaacctatcataagcacatgtgaaataccctctgccctgaaatacactctgagtatcatcaaaacatcaaatatatttaaaattgaattacaattccttaccacagcataagtcccagtgtaacggctccccgcccactcttcccacttctctcctgctgccactctccctacactaaatttctgccacctggtcttcaattatttcctagaatgtgccaagctcattcccactgccatttcctcttcccagaatggtctttcttctccagctcttcgctggctaggcgcctgtcgttccctgttctgggtttatgggttatctcttcagtgaccaccccatctaaagtagccataccaccccattccccttccaccatgtcattccatttcataacaccttgttttagtctttctagtattaacccaaatctgcaatattttatttgttccctttcacataaggggaagaagacaatacactgagagtttttcctaggctgtcttgccttccactttaacccagtgcctgggagcacatggcacatagtaggcactcaataaacacttattggagtaatatgttaatattaactatagaatttctacaactttttcagccttcctgcattatggtgttcatttcaaagtctgtacttgaaaacaaggactacgtctcattcttcttaggttctcagagcctgtgacgatatctggcacatagtaggtgatagaagaataaattaatgaatgaatgccagatagaaaaacatgagtaggcaggatactcatttcctggaagggaggaacagactactttggtagtgaggaaatcgagatcagagcgattcagaactggaagcagctacctcacagtgctttgagtttccaggtatagaggaagatgaaagacagacttaaatgctacaggggtgattaactgtcaagtagtggatgatgctaatgacttttaaggtcacttgctcctctgggattttcttgaattatcccgtgctctgagtttcttccttaaagagtgagattcatcgatggtcatctgatagtggagcagagcttggagtcacatttattccttccttggccaaacagtttcatcaaaattatactgctagaacctgattacgtctgggaatttataccatttacaaccaacagacgaatttaaacgcaaataaaagcccctggtgagctgtttgtcagggcaccaggatggaaagcatgataagaaaatattttgtgggggaacacgaactgatatatggaccccagagtgggagacttgaatgtgaacgttaggataaatgaattccaccacaaagtaaaagaatatttggtgtgttcactttgttaactcaatgttgtttattcttctcaaccaccctaggcagggtcaacatcttaaagaattccatcttcatttttcatgtaacgtcaggaaccaggaagacttgtttaaaagaataaactaccagggaaagaaatggaagttttcattactggaatccaataatattatctttatgttgaataagcctagaatttcaaaccactgtttgtgtgtgtttttttgtttgttgttgtttgtttgtttgtttgttgcccttccctcctgaggttttggattaatctgatggagaaggcttccgaagatatatgtctcaacttccctgattttggtgaacaagaggcttctttggagaacggatctattagacaataaggtaggatggatgcctcatgacatgggaagttaaaatttcaaaatgaccctttcccagcactaacataattgacttagaaggagggaaaggattcctcaccatgtttggcctgagggccattatagagtctcaccatcccaacatttttcactcaaatgtcctcaggaaggtcattattctaattcttccacatctgtggctctgcaggttgccttgtctattattcattaagctggtttccatctgaccctggctcagccatgaaatctttaccttttccagctgctttttgtgtcttgagacttactttattaatgactttggcataaagggtaaagagaagcgcctgaggggactgaataatttgagatgagtatcaagaaagaatcaagtccaggtcatctagaccaagaatcaaaatatatttataaaaataaacaaatgaaattgcagttgatattctgggtaaccatcagaatcaactgtggacctttcaagaagctacttcatgggccccaccctcagagattggaaaataggaggcatgagaactagctatatgctaaagataataaagcaaagagaatgaattataatagtcatttcttaatggaaagtgcttcaaatggggcccttggtttttcttttaaaatgcactttaaataatagaatcaacaaccatgtacacattacccaatttaaaaataaaacactgtaaagccgaaaccctcaggtacaattcacatcccacattgcactgcttcccctcactatctccacccagaggcagtaagaatgttatctgtgtccttccttctaagccatatatagatctacatgtttataaattatatggcagcctataagcaacctgttcttttattttattatttcctgctgttaataactactagtcaaaagtttgtagcatttggatctgtttcagctaaaaggcccaatttcaatcaaggcacacattattgtatggtctttcattccccattctgtatttaaggatgtggtgtagtctaaaacaaatggttccagagcactttaagaggccaaggcaggaggatcacttgatgtcaggagtttgagaccagcctggccaacatgatgaaacctcatctctattaaaaatacaaataatagctaggcatggtggctcgggcctgtagtcctagttactcaggagggtgaggtgggaggattatttgaacccgggaggcagaggttttaataagccgagatcacaccactgcacttcagcctgggcaacaaagcgagactctgtctcaaaaaaataaaaataaaacaaatggctcatctactgaggttgaattggccactaatatttaatcaaaagtactgaatctttctcacatgattaattgggctgcatttattttacttttttttttttttttaacagaattgacagtttggccagccaagtatttggatatcacaggtttaaaattttgaaattagaatgagctgattacatggagttagagatttttatatttgatttcctaggcttgaaacacccatagcaaaatggtgaggcagagtagtgctccttcaatgattagttattgagcactagtatcctatagcaaaatgacaacagtgagtaaccggccttactacatcaacaaaggtaagactctgactgaataataacgccttacatttaggtggtattttagggtctacaaaacacttgcctttcacaggaggtttgacttcacagtgattaagtagaaattacaggctctgagcctcaggtgtaaaagacagtttactgaatcctataaaacactgaatgtccctactatatgtgccacgtgtcggcattacaaatagcaaaataaattaaacagccaaatatccactttgctatatgtcagggcctctaattactgaggggatttgtttggtagtactaatgaaaaattaaacactaaaagcatataattctgccataaattgacatacagcaataaagcagcatttaggttaagcttcacctgtgtaataaacagggattgtcctctggatatttttagatggaaaccaacattattccaagcagagcaaaataatacagattaatatgtggtaagggtgacaaaatatttacaaaacctgtgcttgagtttcttctactgtgattacaggatacaacatatttctttaggaacagcctggtcatatgatataatgaagagttgaaattttggataggcttgggtttgaatcccaattccactatctgtcaactgtgcttttccagtatgtgattttttttctttaaacctcagtttccctaagtgtaaaatattaatgcctacttttgcaggttgttgtgaggactgaagtaagaattataaaactaatggtgaacatgtattgagactttactatgtgccaggcactattttacagggatttacatgcattaatccatttggtcctcacaacactcccaagagacaggatactcttaagacctccattttctaagtttatgaatgaatgtgggggagctcagaaaggttaactcgcccagggttcatgcacctggtaggcgacagctctgggtttgaaaccaagtagtctggccccagagtcctccctcttcatcagtatgctttaacttccctgcattttcttctcaccctcatccctgcttcaggatctctctcatctctttcaccttagctgcctttgagtttgaatgaacagggaaaaagtaaataagaacgtgaaaatactagggagcttggttaatttttctttcagtgctttgatccaaatggtatcatgcaaatcaaagttaacaaactagaaacggaaaaactcaatgatttgtatctacttaggaaagggcctgagggtttagtaggagagaggaagtttcccaaaggagacaggcaggcccccagccccttctgcctggagagctggggactgggggttttgcctcaaatcaccaggagcgggagagggaggggaagtcagagatatttacatgccagaggaaaagggcttggaacctcaacacttctctaaggcgtccactcccacatgtacacccaaacccatccccctgagcactgcagttgtctttggtttaccaacccagtcaaactggattcattctgagggcagagatgcaaattttaaggcaattatacaagataaaagctacagcatcctgaagataccaattcttcatgcaggaaatacatgcattaggtattaacatagtcagggcactgttcaccatggctgtaatgaaaggataaaagtcctatggcaaatcacatctctcttggagtgtctttccaaatgaaaataataagtaacggtaaaagaaaatcattttcatcctcaagataaggctttctctctttctgtacacatcaaatctttcctagaaattggtttgggttgagagcagcagccccctacaagtgcttcttatcactcctttaggaaagcagcttcagaaaagtgaagtgtgcatcagaatcacttgtggtgtctgttaggacagagtcctaggccccacatcagaactaccgagtcagcaaagcatggggcaggcaggcttctgtcctatggctaccttcttcaggtaactgtgaagtactctatcgatttgtaaccgcgacttactcgtgatcatctgtgcatacaccagaggctaaaaatgttcggacagagagggccagtattattttccccaattaagaaggcagatttctgaattttcaaagtgtcatttttataagttcagataagatatttaaatagcacaagtcatataatcagagtaaagttttctcaagaatttaaccaaaaggcagtcattcgtagcgagagaattcagtgtataataattaagggaatttggcagcaccacaaaccatctcaatgctagttacaaccccttaaagcctagccacaatctattttatagatgagaaactgagattgagattaacgttaagaaacatgtacgaggtccaagggccatgatgtggcagggccgggatttgaactggggtggactggtcagattctatatccatgtccaaatcctagccaatctctgctacatataccatgtactgaacatcaatacgtcagtttttctccactatcattcaatataatagatagggtttccgcattcaaaaaaaaaaaacaaggaaattgatgttcagagaggctaaaaggctgatccaaaggtgcacagttaggaagttaatatggctaatattcctaacggaacctctgatgccaaagtatgttaactactagacttaattaagagataaaatgtcctcattttcatgaatctgaaagattaccaaattttcaggtggaaaatttgttctagaaccacagaaacttctcagtgaacagaagagcttcctttttatctcatttaatttttgaattatacttctacaaataattatcttcttcttctagagcaatctaaaaagtaatttctaatatcttaaaagttattaacagctacttcccactgcgttaatactataaaattaaatttctaagtagaagattcaagtaccataaacatagaagagtgtaagcaagcataatctataaacagttcttacaagattccagattacctgcctggaataaatctgtccttaatatacctaaaaccgcctcccacccaaagatgaacataccaattgttctaaaagatagctcacatttaacttattaagcagcatcgcttctaaagaaatgaatattgccttaatggttagattagatggaattacattttggaacatgatttgagaacttgattcgtggaaattttagtcttcgttagtaacacctggaatatagaagacttttgatagagattccaggaatattgctgactgcatgctggaatacacatacatatcgtcttctacttcatgttaactaaagttagaaacttatgagattcgttccaacaagcaacaagcaaagttccattatcatcatcattctcttccccacacaaaagaggcatagaaaataaaccggagaaaaagctgtgtcatttccttacccattgcccggttcatggctcagacccctgtaacacaatacagattaacgagaggaaagcctaacgaatatatttaatataaattttatgtgccatgggagcctttagaaataaagacctaaagacaactgtgtatttttacggacagtcatgcagaagtatgattggatgataaaagagtatgacttgatggtaataaattggggaaaacttagcaaggcctgtgtgttcagattcttcttggcatgtgagtagagggcagaactcctctggaatgaaggtcttatgacctacttgcatgggtgttaggtcagagaattcttttatggcacacttgagggtagacaaatggaaaaaggtcagagagtgatgttcctgcttctgtagttttctcagtttccttcaccttaaaatactcagtatgcagagctagcatattttgggggtagcgtgtcctgagacctatcataaacaatgacaaaatccaggtcctcacaaagcttaccttctcaaagaactagagaaaagacagaggtacaggtgcatagccaaacaaacaaaagacaatgaagaatgcctcgagagaaatcaaatcatgcaccaggacagagagtaggggctttaggagagctacttcagatgaagggtcagggaggctgtttggatctgtatggttgaagatgaaagaaaaagattatttctcaagcctgcaggacatcaaactgctgcaataatcaccttgtggatggcagggttctactccttttaaacccaaaaaggagagttaataatcaattgtgaaataagaggtcacttttttactttgatatttccctttcctgactacaagtgccttactgagtaagcaaggccacgcttgttctttgcaaagcagaatttaaagcccctgaaacaaaaaaaccctacagtggtatcatgttcaagaggctaactcagtggtgcaccttcattaacgataacaacaggtgctccaggggaaaagaccattactgggcttattgctattaccactcagcatgagacaaaaatggtttagaacccagggatcaggcagaatctcaagaatgagacacagaggcaaagatgaagagaacagtcactgtgctttccatggcaggttgtcaaatgctgccttaaaatgtgcaactgtgtgaattccaaaatatgaaatgctcagaggcttgaattgtagtattcacaactggacagctgaatattaaagatgctgctttgtcccctagaggggctggctactgcaagactggcttccaggggtcataattatgtggccattgccactcaatattttatcatcatacaatactgaggctggcaaatatctatcacgggatgtgcttgttaataatgaagattcccaagccccagtcacagtattctaaataagtagatttggaataagaactgagaatcaactttttgttgttgttaactgataccaaagttaattttcatgcaggtgatacaaagatcgcattttgaaaagcagattcaacaactttagatatggatactttgtctaaaaggacagctttggaaccttcattgttctctgggattttatgtgtgtgtgtgtgtgtgtgtgtgtgtgtgtgtgtgtgtgtgtgtgtgtgtgtgtgtgtgtgtgtatggtggttttcttataaccaccatattctacaaacgagtcaagatatccccattatttcatatcaggaaacttctgtgatcaggttggaaacaactgaaagatgtgcaaaacagcataacctgctgatttaaaaaacagaatcgttttaaaaagttcaacttaagctaaataatcagggtgatgataacaataaccacattcaacaattcatatataagtactatatgttaagaattagtccatcatcatcaccatcaaaggtaacaaaaacattacacattttggccagataattgggacatcaaaaagtaattactattggagttacacaatctgtagccatagttatcagcccagctaggctcactgcttatttgttttgtgtgtgtgtgtttattatttttagtcaagagataattcaaatatgataaaattcaccattttaaaacgtacaattcagtggctttattatattcacaatgttgcacaaccatcaccactaagtccacaacgttttcattaccctaaaagaacctgtatccattaggaatcattccccattccttccttgtcccagtccctggcaaccactaatctactttctatctctattcagagcctgttgcatagcaaatattttctatcccgctttagaatggctaaatgaaattttgagatcatataacctatctattcatataagttttagctatgcttactatgcacctattatcattctgtgcatcccacttaatacagtttgtgcattcccccatgtcactagctatgcctctacagtatcgctttcaatggctgaaggaattccatcaaatagatattgcatagtgcatctaactaatccggtatagttggaatttacatttgaatactgagttttaaaaaatcttggaaccaagtttaaacatttgtgttttgcatttcaagaagtgatttcaaaaagaagccacaggtattaaatcctttctttgcatccgtatatttagagcctcacatggaggtgagacagtgggacagaggaaagctgaaagcctctgtgtctatcaccataccctgtgtgtagagcaattaggaggctagcccttttttatgataaggaatttggtagcccatatggtggcagtccctacataaactttcactgcttagaagtatttcccagagattgtattttaaaagtcccagaatagctgtgttaaagacaaaagtaaagtaagatcaaaagggaacttacgtttatttggcattgtttgtgtgggcagcaccttatccactcacagctagtcttcgaagcattaaactttatttcaacaaagtgtaacattaacatcccagcctgacttgcttctgacttctagcaccaaaaatagagccttttctatgacttaggtgcagaatctacccgtataggaattagcatttgtatgaaaagagctgaaacccagcttctgaatcagccaggattttattattttatttttactacagaagcagagactatcctaataaatcctcctttcttctcctagcacacttaaaaacccatctttgagctccactgactccattaggtttgaactttggtattaagtacacagggaggaaaagagtaggtgtgggggtgacgagaaggagaacagagagaagcacaggagaacagaaaggaagggaggcagcttgatgctactgctgcggttattgcttcactcaaaaacaatgaagcaaaagcagactatgtcaagaagcaaaggtgtgtcaaagacaccccaggcttaacatggggctgcacaaacccacaggaagctcacatgctatttcctagacactctctcacatgaaccactttgacttatgtttccggactccttgatttagtttctgttttagcgtttgcacaataataattttactactaaaagtaaatgtcttgtaaaccaatgggaaacatattgtttggcagagtttataatgtcaggatttacggctctaacactgagggtctctctgacctcgaagataacataatgaaacagcaatgtgctgcatatgactcgttgtgattttttattagttctcataatcgcctcttattaatttgtatgcacataataagcactcaccttcacagtctgtccggcttcggggccatcctagaagtaggaaaaaaccaacagaggtgagaatagatagatggtatctcctgcttattcagaaatatcacccattaataatttagatgcaatttcattgtgtgttaatttatagtattctcatggggaccattggcttcaaatgtgcgggattagacagttctccatttccgcctgagagtaagtgcgaagttatgtataaaaatgatataaattatccagcaagccaactccttgctacttttcatgctctttgctctaggctatggttttaattgcattaaaggaaggctgaaaatgtttggggaggtgaagtatcacaccttctggttatgtttagaggtggtttaattaatgtctgattactttaagcttctactcaggaaatctgctataaacataagccattaaggaagaatatggggtatttcatatgggaagagtcctctggctattctgaccttgtgggagacaaatggtagtgttcattgtagctggacccttttcccaaactggttccctttctctgtttctgaagcttagttggaaatgggcaaactcaccaagtcaccagccataatataaagcaaaagcagatactcagctggttgagatggccaaacaaagcaatggctccacaatcagaaattccaaaatagaatttcacctctgcaactttagccaggtttgtctacctctatgagcctgactaacggggtgagaactcccgccgtaaggattaagcataactgtgtatatcagggattttcaaacttagagtcacaatccattagtgggtcatgaagtcaacttaatgggttgcaatcagcattacaaacaatgtaaatcaggtgttttttttgttgttttttttttttttttttttgagaaagggtcttactcagttgtccaggccagagtatggtggcatgatggcggctcactgcacccttgacctcctggactcaagtgattctcctgcctcagcctcctgagtaactgggactacaggcatgcaccatcatgcctggctaatttttgtatttttcttagggacagggttttgccatgttgcccaagctgatctcaaactcctgagctcaagagagctgccggtcttagcctcccaaagtgctgggattacaggtgtgagccaccacacccagccagaaatcagatcttaatagaataaaaactattagactgcacagaatgagtaaacattgttttgtgaaactctggtttcctttatcaatataggcatatgcatatatttcatatatgtgtgtcaggggagacaggcatgattttgaaataaatatgtatcttactgtaggttacagtaaaaaatagtttgaccacattgcatatacgaaagtactctaggtgctaacacaagtcagctcttacatttatggaattaactttctagtgaaaaatgttccataaccagcaatggccatttcctataaatgtgatttttattcttgtatctcactaaacattaacagaggttttcattcactgccttcatttagtctctccagaaacacggtttgcaacataagcttgataaacccactctgaactgaactacctgcctgaaggggactcaaatggtttgacatacaacacatacacacaaagcatttgggggaagtttagctactcttaacacagacatggcagcaaaaaaagaaagaaaaaaatctgtttgagaagaagatgagcacttttagtcagagccttcataacctgaaaacactggctttctttatctggtctctttgaagctctatggtaaagagctaaggaggggaggaagaatggcaaacattcagtttaactaacaggctgagtacagagtcctcacattttgaaagtgtgtccttctaaagggcaattacagagtcatccaatttcagagccatgaaggactttatacattgataccccagccctttccatagagggcctgaaggagctcatggtatgttactacggatttactcaattccctactgatgactcaccatggacatccttctcccaacctgacaactgttggctcaacctctgcctaaaaatcttcagtgactggggatctgatttcttcactggtcagtgggccacacccaaccagtgaatctagcttctaactaatctgtgatcaatctctgcatcttgaattaaagacagacaaaaggtaaggcccaacctaagctgcatatcactgccaccctggaattagagcagggcttagtctatgcagtgctcaaaaattagttaccatggaatgaaaatgatttttccagtcccagttccagtaagcaatttggaatgtctgaatgtccattaaatcacttatccattactcccacctgcttggtaaacaagcctcagacatcaccttagacactatcccacggtccatcttggggccaatggacagtagggttgccctgcattagaaatctctttttttggctgctacctaaaatacaaacaatcacatctgccctcctggtaagatatcaggaggagcaagcccaatgccgggatatgaaagggaagaaaaatcatttctgagaaatctgtacactcacctgcatggaaaaggtgagagaggtcccatggaaatgtttttccaccactgtcccgactctctgggtcgtctgaaacaaatcggccacttcatcaggacgcaggtcatggaagcgctccactggccgcagcgggcacacaaggacatctgtagcaaggtctgttaaggcccatgctgctggctttgggtagtgttcttaccaagcagttcatacccacaggattgaatcctctcggaccagggcctgaactctcaaagactaaggaatgaagaaacagatatttaccatccactgaactccagagagttgaaagagagctcccatacatggataattacactttgaaggagaagctgtggtatgcagaagaatttcttgcaaaagaaagggacattcgtgtacagacagactcaagtgtatggtgagataattatgcgaggaggcaagatctattctagatcattctctcttgacccctattctaaagctgtgtccgcttcagcagccaaaggcactaggttgaaaaagcaactggaatatctacttggtttctctaggtagaacatggggataaatttttaatttaaattatctctttagagaaataagaaaattatgcaatgaacatacaaaagtagatgtttattttatttttaaaagagtatagacattctgaaaatgtacagtgaactttatccataactaagagaggtgccatgtggttaagcaatttatgacaagagttcctcagactaattttttttttagaatccaaaagaagacatttgaaggtaaatcatgaacgaaaggttgtctgtttattcaaataaagcattcttaatgcattctacaagttagacaaggcaacgtatttacactattggtctcagcaacatataagatctgagaaaaaaggatagaaatttgattacttcttgataggaaattaatattcactgttacaccatcaataacatttcagtcactatacacacatgtatgcacacatgtgtatatacacacactatatatataaatatttgtttagtttttagatactaacaagagaaacaaactcttgtacgtttttctgtttcttttttcttgttgttttaagacagcatgctcctgcctggagctaagcagctgaggggcataataaaaccataattctgcaattgctagtctcactagaatatcaaccccattccgctattggtagaactcagagcccaaggggaaacacaactgagctcagctggtcaggcctgatttccataagagagaggggaagagaaagaagaaactgattaattttgctcataatcaggaaattcatgtcaatggtaaactaggaaaagaagcatttttaaaatcagagttcatttttcaagagaggagaagggaggcgttcacccacagggcatctgatacttaaaaagataattatccatctttggcaggcccgctttattatcatgggtcaatgaaccatttagaaatgaagaatttcctttcatttcctttgagcagattgccagcctccactcccacgaagctgctttttctgtgttaaaagggacccttccccatattcctcctccctgatttgaattacaccctcacttaggcctgacttcaccaaaccacagcaagggtgacaaccatgcaagcttccaacgaagtccataagtgctatgttaggctatgttcacacacagcaactcggtgggggaggaagacatttcacttcaacaatggcttactgtgaaaactggtggaataaatcagacaacctatgtatctaatgtaaatttagtaatatcaatgacatccaaaaatgttttttttcaacaccataaaaaaacttattgtttgtcaattttgcttgtttgcatgttgctcctagaaaaacaactcagggaaagcaaattaattagaagaacagcagatagcttttgtaattctaatgccactttttatatgccaattgttttaaaataatatcacagatgcaatataatttaatttggagcctcttaggccttgttaatgggtaaattccatattatacataggctatgaagacacatttacttctggatcctgtttgcttgggattatctcctctgtcaagatttcttagccaacatgtaggataacctttaaagaattaaagttactatattgaattgaataaatgttttatccagtacatatcatgtgtgaaaacttgtggaactggttaccacttctccctataatctagagtatagagtttttttagcaataatattttttaaaggaagcgaaggtcaatagttataatttaggttgtatagctgacaaggagatttctcacagtagatgaaaaccaaaggcgacttcttagagcagatgagatttaaactggactttaaaaattggggagtgatttaaccagtggattgggctggcaacctactcactcatccatcccaacactgcagtctcctctcagtccagggtctatgctggaacttaggatgctaagatgaccaggacagagtagctgaccttgaagagttcacattctaatgtccgcaactgtcatgcagtgtaaacagatcattacaacacagagagatgaatgctattggtagaaatcagtatagaaagctgtgggagcacaggggaggtcagatctaattctgcctcagggtgttagataaacttttccatctcattttacatttcaccttttaaagtagaacaatttctccacacctagaccaaaatctgtccttaaaaatggtccagaaacttaaggttagcttcaaagaaagttgttaagcgttcctcctttggcccaaatcaccatttcacttttgtacgtactcttacttactcaatctttccaacaaacccataaactattaatactattataattcccatgttgaagatgaattataagcaataatttcttatagaaaattagaaacttgccacaccagcacactcaaaatgagattaaaactagaattcaacccgtctgtccgattctaaagttcatgttattaatgacagtgctgtgatgtcatgcttgttagagctttcatgactccatttttgcctagcctcttattaaaactgtgccctgcattccctagtcactctgttcatagaagggaaccactgttttcattaaatagaaggctatgatgcaaacatgctgaacgcttaagaaacacctaaccttggaaaaagaaagcagacgagacctacaatcccacaatgaaaggaggcctcagcactgggcagtgagtatgccttcatcctaacagagaatcgtaagatcaaaaaggggggagagtaccagcttgcctgaactggaggaagtaaagagggatacaaagctggcattttgccccttctcatcctgactttgggttgcttcaaggtgacttgggctccatcatgggccagactcctgagaaagtttagatactgcagcctctatcactgggtcaggttgtcagacacactgaatccattgcttgttggacagtctaattactgagaattatggaccttctcacaacacatgattcatatcacaagagactaccagaaacttggcaatcctttctttttgttttcccttttcgtctcctcctcttcatgctcaccaccagcccagaactgactatctctctttttgaacatgaacactttaggtgtttttgctgcattaaagtggtgtgaccacatgccaagccctatgctgaactcttgctgacacactgccaactcagaatacacacaatgaaagaaagacatattcgcattagtcaggtgcctagagctggtgtggtttgctatttgcaaatgtgaccacaagaatccctcccatcctacacatgctgttttgctctctggctttcccccactttccatcaagagttgcagtctatttcccctccccttgagtgtctatcttactttgtgtttgtgttgttataaaagaacacctgaagctgggtcgtttacaaagaaaagaggtttatctggctcacagttctgaaggctgtccaagaagcacgatgctggcttctgaatttggtggaggcctcaagatgcttccattcatggcagaagtggaagggaaaacagtttgcagagatcatatggtgagaaaggaggcaagagagacaggagggaggtgccagacccttttcaacaaccagctcttctgggaactaatagagcagtagagagctcactggttaccacaaagatgacatcaagtgattcatgaaggatctgcccccaaacacttcccattagaccctaccgccaacatcagggatcaaatttcaacatgaggtttggagggtcaaatatccaatctatagcagtgttgctgtgtgactttccaaggttaggccttaagtgaccttgaaacctctgattattgctctcttggaagcctgagaccaacatgctataaaaaatcccagctagcctgttaagtggcaacatgaagaaagaactaaggcacctcagctgatagtcagcaataactgtcagagatcatctcagaccttctagagtcaggagagccactgacttccagtttctatatcacttatctactgctgcataataaactaccccaaatcatagagccttaaaacaacattgatcggccgggcgcagtggctcacgcctgtaatcccagcactttgggaggccaaagcgcgcgaatcacctgaggtcagcagttcaagaccagcctggccaacgtggtgaaaccccatctctactaaaaatacaaaaaaaacagctgggcatggtggcgggcatctgtaatcccagctactcaggaggcagagacagaagaatcccttgaatccgggaggtggaggttgcagtgagccaaggtcacgccattgcactccagcctgggctacaagagcaaaactctgtctcaaaacaacaacaacaacaacaaaccaacattgataggttttactaccataagtctgtggatggtttttgctgagggtctcacctggactcactcatgcaactgctttcagatggaaggtaggctggagtctgggctcagctgcatccactaggcccttcactctacatgctcttccatcccaatagatgcagaatctctgaatttgcttaaggcttacattgtcccacattctatcggtcaaagaaaatcacaagccaacccagattcaaggtagagatattctgtcttctaaaaggaggagtggaaagatgacagtcaaaagggatatggacactaggaagttccagggatgtttaaaaattaacaggggcccaaggtatcttggctgtcctagtgagtaaatacaggatggcattttagagttgagatgctcctttttttttttttttttcctgagatggagtttcgctctcgttgcccaggctggagagcaatggcacaatctcagctcagtgcaacctctgcttcctgggttcaagtgattctcctgcctcagcctcccaagtagctgggaatacaggcatgcaccaccatgcccagctaattttgtatttttagtagagatggggtttctccacgttggtcaggctggtcgtaaactcccgaccttaggtgatccacctgccttcacctcccaaagtgctggggttacaggcatgagccgccgtgcccagccgagatggatcttaaacatcaactactccaataccttcactgtcagattttaaaaatagggagagaaaggttacttaacttgttcaaagtcacacagttaggagcacagttgggattggagctcaactggtgagcttccccaaccaaagctctttctgttacactgagatggcaaaacattgcacatctgccactattttccaatggtaaacttatggcagaataatcgaccacagaattctctcctttaaccaaagtgtccccaaatacttgccaatataacctctgagcagtcaacaccagtgagaatgggcacgcgacatgagatgcatgtgccatttctgtggcctcccacactgcctcatgaaacacagaaccaactgcaaaggactggtggagtcagaacaaagggggatgctgcaaaagggagaatcttcccaactacataaaatttccattatgttgccacatttttattcaaaataaatttgataagttcaaaatttgctcatcaaggataataattgattaaaaatatttttaggaggatttccatgacaaatacgaaatatttaaacatggagcactgacagataaatggaaatgtactgattcagatgattaattaaagatgacagcagaatattatgatcggagttgctcagactcgcccccatttagttttctatatctgatctattctagggattcagaatatagaagtcaccaaaataaagcaaatcatcaaaatatcactgattttgattaggctgattagcctgtgtatatattaatatgaagtaaggcagtatcagataatacaacacagaattaatcattcttctgaactaataaaaaagagtctgtattcatctcgactgcagatctgtgtgtagtttagtgataagcaaggaacattccagcttgcaatgcagacctcagcagaccctgtataattcattatttgctctaacaaacactcctaggccttgtaaatgtttaaaataattcttaatgtcacttcacaaaacaatagcaggatggactgtcagctacttttcaagaaaatattcaatttatttgatttaaatagcacaattacagagctttgagtcaaagtaggcggcatctcaaaaagtaatctattcacaacgtaagcactttgatggattttcatatcagaaaggcagaaatatcacccttaaatattaataaatacaattctgaagaagcatcttgctttgtttgggccacaccttttttcagtggggattaacatactcatttcagtaactcaataaagggttcatgggatattcatcaaccataaccataaatgacacagatgtaattttaagcaaatgtgatttccagaatatgataaattccagagcagtgtgattaagataatgataacactctgctcagagctggttctcaaggcaagcatctcacaaatatccactatctcatgttttgccctgggatatgctttgggtcagagatatgatgagaccttgttcatctggaggaagagaacccaggtatccttgtctaggcaacatgccctgagctgccctcaaaactccggtaccgatctggatgctcaaaagtaagaatcactttcatcgagagaagcaaacagttgcctttcaaagaaagtaaattgacaggggagtccgcagcccgatagcattctggtacagattctttggttgaatttcacatatttttctgtgaacttttcaatgcaaagtaatcttatactgattgagggaagagcatcatatctggaaaaaaatatgctcatataaactaagtatgtgggaaagaagtaaatgatatcattaaaggaaagaaacaatatataacatttgtttgctgcctagtatggtctagtgataatcaataaccctttgagttaggataatatcacctcccaatgtccagattcagaagttgaggccaaaaaagtttaactgcataaccaaggtcacgtagctattaagtgaaaatcccagccaggggcatgtgctacaacactgttacaatgtccatgctgtttcaatgcctctcaaggttataaaaacctccatgtataatacctactgcagtgtttactagagtgggatagcagagccctgcttccacgggatgctgttatacattatacagaaaaaaaactgtgcggtcaaagaagattgagaaacactgcatgaaatgaagtaaaatagctctctttaccgcagtattcatcagcatatttactgtactactatgcattctggcttctcaaaaataagaaatagtatgcagcactgctcaaatttgcttatctacaaaataataatgattattaattattagtaatattgtagaacactacacaggacacatgtttcagaggatgttctttggaaaccttgagcatcatttcccaaaacacagagaggcctgagtaatttttctgttttttcaaacaaaaagttgagtacatgtcctattaatcacatgggcaaagaaagagagcattctgtgaaatgaaatatgctgagaagttgagcattaaaatacatcaaatgggatatggcagtcattagtgctgtttgccaaacagttcaggttactgccatgtctgggcatatggtaggccttctggacccttgcagttgggtgaagctcaaggaatacaggtcaaagagttgtgagcgaaaatgatatacgtcacttctgggctaaagcccttaacttctagtatgtgaccgacagctttatttccttcaccaagacaggcagcaatgctttgcaatggtagctgctctggcagtgagaccccgaattataggtcagcaggggcctctgagcatcgtggtcacagtgactagggcaagtttgttcttaaataggttttacctcttttgctaaccccaaccaacttgtagtagctatttacagcagcatgttgaagaggattctgaagctctgataaggagcaggaggaaagaactgaggaatttattagttttggctgccaccagggaggaaaaaaatattagcgtgtataccaagtacctgccattcttcaattagacggcaataaaaatgttttttcaagaattctctctcccccattcttaatgatatagaagtcatttctgggacttgcaatgtctctcagtaaccgttatgaaaatctattattattgttattgtcctagagatatacagaagtgtctagaatttagataattctggttaggagagtactgaaaaggaaaattaactgtcactcgaaagagtctgtccacaatgtgtaaacatgagaatgggaacacaccaatatgaaaatgagcatgttgtaaaaatgctcttaggagttaagacttgaaggagtatggcaatagaagaaataaattgcactcagcagctgaagaaatatttaaagataactccaatgagagattattttaaacttcagatacactttgctatgagaatcatttcaaaaactctgtaaaaagctttttagtgaagtagagatgagaaagtaatactaaaaatctgcaattcattgcagatctagaaaaccacatgcaacataaataatttaatagcaccctcaccatatacacagtttcatttcaccagtatgtgaatgaggggagtgccctgagcacatacctccatagggtggctagagtgaaacctggggcccaaactcccacatagacaggattcttccagtgcaagctctatcaggttttgaaattatggattccaaatttaggtttgcttatgtcatttaagagactaaaaattccagtttccctcagatcttccatatagctggccaagccaatggagcaaccagacaacacagttcagatgccatctgaaggcaaaaagtagccaaactataaatatgaaaggaaagaaataggaaatgagagaaagggagagaggagattaaaggtaggggtggtatttagcagatgaagcctccttagaagagaggaaatactcctttatagataggctcaactaggattcctggtgctacacacagagcttaacatagcattggcctttaataaatacttggtgaaaaaataaatgtcatgtaggcttattcattgtttaatctgggaaacaattctttctaatgaataatttcttcaaaatgctccccaaactgtgggttcttaaaagaccagtgaaccagtccagactcaacttacttaaatgtaaaccattaagaaaaatatacttcatggtaaaaaaaaaaagaattatgaattcctaatacaaatgtaacatacccagctaaagggatagaaaaataaatacaaactggtctttccttcacacatcaaaagtagtgcatgtgttttaaatggaaaacttcagaactattaactcagtgaagcttggaaaagttcaaagataacagtgttctatgctttttaataacaatgaggaaccctcttctatgacagatactaatgttaatagaaacatcctttatttcaaataaatgaaagagagtcacacttaacactaatttggcattctcacagaatatgaatcaacgtctttctctcttaaaatcagtcctccatgagctagcaacctaaaataaatgtgaagatttcgtagtgagaggtattcatcatgtgttcagtgaatgaacttctgaatgaattagtgaaagatcacaaagttgaatattagagaaaaggataaagccaaaagactttcaagaactctgtatttttttgtatattcattcagtaaatatttgtgaattaagagccgactacctggcaagtactatataagacactgaggatacagcacaaccaggtacagtcatcctctcccttccaaagatgtgaaatctagagggtgagcagacaaaggcaactgacatagtaactactgtgaaaatataaggggtgagatgagaaagaaaaggtgcaagaatgcaagggcaagaccgtaacaagccaaaccagctaaggtggctgtgaactaggcccagttcacttggtctaactggatcttcaggaaagagtgcaggcccttgatagccttggtcagcagtctgtatttattcgccatgcatggagaagccactgaagcatttcggagagtggagatgtatgacagattctgggttctctttgcaaagctgaaggccactgggaatatctttattgcagactaggtaaaagattcaaagcaggcctggcctgtggtggtggcagtagagatgcagagaatttgagatgtatgtttgaggtaggagcaacaagacttaactaatgggggcaaaaaggaagagaaggatcaaagaggattccaaggttctggcttgggtagtaggtgaagagtgatgtaattttgagatacggtgggtgggacagtgtcatgtagctcaccatttggagacttttctttcttgaatttatagaattctccagaaataactagagcagagtttcctaacctgggtctacagataggctccagggcttctatgaatctcctgaaattgtttgcaaaatggtgcatatgtgcacgcacacacattgttttcctctggtataaaattcttaaatagtctcctgaccccaactaagataagaaatctagatttaaatcagaagaattctttgaagattagtccccaagagaatgattagaaacaggctcagacttttgctcactttggcttagaatctaatatacccagtactaaagagtaagaaaagaagttcactctgtctgagcaatgtgccataattcacaagcatgaagcctccataaaagacaaacaaaagattttttaatgccataacaccgaagtcattttaatctgattcagcagtgaacaatttaagacatgtctcctccaacaaaggcagctggacacataaagatgattgtgtgatccattcaaaattaaagaataagctaaatcatttacaacaataaaaatgcagaaaattctaccagaaaaaaaaaaaaaaagagagagtgaaaactttcagcagcaagtgatttccaaatgtttccaaaacaggaagcaaaagacattttaatgtcactgtggcagcttccagaatagagtaagttaatcaggcagcctctaaaaacaaagcagcaattcattaaaaacaacaactgctactcagcaatgaactgtactgccagagtgtcaagaaagcaaactttttcaagatagtgatttgtatgcaaatatagctcagcatttatcactaaacctccaaggcctgtaaagggggggaaagaaaagttctttccatctgcttacacctgtctcctaataaaatcaactgccaatcacaggggaggctggggcattttaaaaacagtcaaagaaatacattcacaaatccagggtttcaaacaaaaaactcctgtctactctttcttcttcaaatctcctagcctactgtcctcttcctaaattggagttaatatctgtacctacttcattgggatgttaaaagtgttttttcaaaataatagcatatttcacaccaacaaataaaagctgaacgaatggttggtttagaaaaaaaaaaaatagtcaatggaaatgaaatccttcaaagcttccctcaatccagcaatggtaatgcggttatgtgattgaaacagtgtctcactagcaccagtgttatcgtttggaacccagatcttcattcatctcatgtttaaaatgtctgtacttttctacattccactcacccacccatctccattttctcatttgatctctgttttttatttccccctcataatgtaagcatcactggtagcagagtctaggaattaatcatcttataatcatttagtcttcctctccagttctaacttacgactttttcaaaatatggttgctaacaataaaaaaaatctcaaaatgtgaaaacaaacaatggaaaaatattgtaaatatttaaacgcatttagaatttgcaagtttttttcactctaatgtcatttttcaagctatgtttagacagcacagaacactatatggtttacctaatgtttaaattagtagatctggccaggtgtggtggctcacgcctgtaatcccagcactttgggaggccaaggtgggtgggtcacttgagatcaggagtttgagagcagtctagccaacatggtgcaatcctgtctctactaaaaatacaaaaatcagctaggcatggtggcacacacctgtaatcccagctactcggaaagctgaggcaggagaatttcttgaacccaggaagcagagcttgcagtgagccaagataacgccactgcactctagcctgggtgacagagtgagtaagactgtttcacacacagacacacacacacacacacacacacacacacacacacacacaaaattagtaaacccaataatccacaaagatctataaaaatatgaacttacaagatttctatatatttgaatttcattttgtatataactgaaaaaaaatatttaagcatgcctaaggaaaaagaaaactgtggaaacaaaacaaatgttctggcaattctgcaacagtttcacatttgtatattgttattcctcctgaagaatcctaaaattcactctcattttctttatatgcttagatattaaaaacatgtctttgacaaccaacagtcttctgtcatggggaatcagacatcggccccataatctctcattaccaacatcaccattgtcactgtctttaccatcatcacttaaaagaaaatagaaactgcttaaataaccacagctaaaataagtgtcacaagtttcttactgattaaatgctcctccgcgagactgcaacctcgaatactacgccatagagttcagattccaacacctttaatgtttctataaggaaaaaaaaccacaagcgttctccctgaaaacgtactcttaactcagaatctcttctggttccatttagtttataaaaaaaaaaaaaagaataattcagattgaaggatagtattttggattttcagtgttattgatattcctcgatccatcataatttagctaacatagatcactgcctatagagcagtgctgtctagtggaactttctatatcctatactgttcaatatagtagccactagccatatgtggctactgagcacttgaaatatggctgatgtaatcaaccatatttaattgcattttgttttaattttaattttacatttaaaaattaaatttaaactttacattttaaataccaccctgtagctagtaatcacttgtagctagtagctattacattgtacagttcatcaggagaggccacaaatttatggtaacaaggagtggtggaactggcacaactggaaaacacatgccccaaggtgggtggccaccacctagagatttttttgttcctgaagaaactagaaatttgaattgctatgtgtaattctcttctatttaacttttggcaactataggcagtccttctcatggttccaatatgcacatatttcagttactccagtttaaacaacaccaattccccaacaacacggtttaaatttcagttaccatgtcacattaactctgggtcattgggtaaagtacaagctccactactagctcttcaattcacaaattaccatgtagatcatagatgtgcatgatgatcagagaccagtcacatcacttcttccaaagtctgtcagtgactgatcactgcacatctggtattcagtcagaggcagccagcaaagtatgtagttttgtatcccactgatcttccagtgatgaacccacatatttcaccaaaatggataatcgaaagagggaactggccaagaaatatgaaacacaagtgaccaaaaacaaaaacaaaaaaccaaatgtgacaaccccagaagtgcactttgaatcaaatgtaaataaaattatagaacaaataactgactttgggaatgccaattgcgctgatgttcaggagattctagatatgtaacccaaggaatttagtaaagacaaacttattaacataaattaccaaagaatttatgatgcagaagaaaaagatgtaccagaggaagtgacatcaaaaaagtcacattttaaaaaacgtcctatttcatgacattgaaaacacaaaggatgaaatattggaaggagatccacactttaggagggattatgacaatcagccaaagcacagaaaagatgccccatctgtactgttagttgcaggataagaaaaacaaggcaagaattgttcaagagactctcaataagtgattttcaaagaaataaagcacttcaattcttagtgtttctaatgttttaaattacagtgtactaaattagtattagttcgttttttacttctttcattatatttttctatttctttatactctgataacttatagagggtttttaatgattagagaaaaacgttaaaggtcatagaacagtcatacgttttcccattgattactaagtggacattgcatggtttccgcttgcgtggtcatttttatagtcccacactgctgtataagatgaggggtacttgtacttccaatgtgttaaaaaatattgggtggggcaaataaaacatataggtaacaggccacaaatttaaaacctgtgccaagaactagtgtcatatgtgatgtgcatcttaatattaggagagagcagatgaaggaaaatcaaggactgtgactttaaaaagacatatatatgcagtctctctccagaaagagcagacccgtcgtcatatgctcctgaattctcccaccacactgcctggcaaaattaaagtcaaagttctcttttgtttcccaagtagcctgagaactgcatgttactgtctacctaaataacagaggctctctaaaagaaaatgatatttattgagaaatgggccttgtcttgggaatacatgtgccacagtaaattatgagtattcagccaggtgaaggaagacaaaggtttttaaagggcaagtgaggagaattacctaattgttttgaggtaattatccttggttactaggatcaataacattgtagcaccagaaagaggttggacaggcagttgttgggcagatgtcctcatagaagcattgtgtgtgtgtgtgtgtctgtgtgtgtgtgtgtgtgtgtgtgtgtgtgtacaaatgtgatggccttggtgcagcgtggctttttgcagagtcttttatgatagtttttgttatcaggcatttgtacatgagaacgctcccgtcatggcctttcctagctctatttgtcagggttttgtttgtgactccatttgattctgacaacttttatattatcaaacctcctgaactctgaatgcatcattaaacctggctgttagcattaaggtttccccaccaaatgttctcttgtacatcacaatatgactgaagggagattacataatgagtaacatcaataccatgcatgttctatattccatatggataatgcgcaacaagcaaaattcctgccaaaatccttattttgacacaaaaaacagaatgcagctatagctgtatgttttccttcacaatgttccactataggccctttctgtagtgcattatctgccgctggtccagaagctctttaaaaacagaggccacttatttttcatccttggatccaaagaccagcatatggagcccaggttaggacagatgtcacctcttagtagacttatcaatcccatcccatgaaggtatccctccttccttttcttcccatttgtttgtatccctcatagcttatatcaatcttgaaattttagtactcatttatgattacttgttttctattgagaatgcaaactgaaatgagggcagaaatcaggaatgtctgcttctcagctgtattctacctggatacagtatactgcccatagagcacttgctaaacactgaattggtgggtcaatggatggatggatggctgggatgcatggacggatggtagatgactgggtgggtggtttgaaaaaatgtctaagggaatgactattagaacgaatgactgttgaatgaattactgtttcattaataaataaaaataaataaataaaagctaaaactattattttagtaagtagagagtagaaaaaataactgttattttcttaatgttttataaccataaacataacattctctgggttgtcttccttttcccaagttatgtcctcagataaatctaaaaatgagaattcttccaatgggtgatctcccctggtccagtccactatttgctgaactacaagatggagaagtttcactttgcagcagcatgtgtgaaaacagcttggaaatttttgtagagaataagctcaagaagagtcaacagagaaatgttgtttctacaaaacacgttttatctcagattgtgaatgcaagtctggtgttgagttgagggaggtgatttctcactctgatcttattgacagggatagtcatggagttttctgtcaacctgggagccaccaggaacagcctatagcacattcacaaaagagatcagtatggctgaagaaaatcaaagaaaagagaaatgaggaaacaagggtcaacctttgactatagcattgcaaaggcagtcattctaggaaggaggaaagatgcaggtgaaccaactagtaaatggtagaacagaatctgaatccagcatatgacctgtggagtgactcagatctggattccaattccatttttgccactttttagccatttgactctgggcaaataaactcttatcagtaacctcacctgcaaaatggggcttatttattctcatggaactgcatttcagagtaaccaaacagcaccaatgatggacaattcttcaaagaattctagcattaaaagcaaaaggacccccaccattttaaatccctaaaaatataactgactcatgcaaaattatcaacaggtaatttggggcttaggtcaggagttcttaacctgggggtcccacagaggcttagcagagggtgcatggataaaaggaaggaaacacatgaacatgaatgaaaaaaatgacacacagttatttttactaatttttaactaaaattttgtatcttattaaatcacagatgtaggcaatgaaccactgtagtaacagcagtacctatgagttgtgtcacagtataaatcacaggtatttaaaaaatatgtaaagtaataacttgatagttattgcagttaccttgaaatatcatttattctagaagtacttatcattacaattactatcacacaattatgatggtcattatagctgctaccacttctcattatttaatatgtaataaagaaatgcataattcactgtatcacaaatttgctgttaatactgtgttaactggtattaaataacatgaatttccttggtacttctctatacttaactgtccttaattaaaatcattattgggtgggagggttgctcgaggctaggagtttcaatccagcctgggcaaagtagtgagaccccatatctaaaaaaaattagctgggcatagtggcgtgcacgtgtggtctcagctactcaggagactgagatgggaggactgcttgagcctaggagttcaaagttgcagtaagctatgatcatactactgcactccagcctaggtgaaggagcaagaccgtaccttgaaaaaaataataaaaataaaaaataaaaacattattgggggaaaaggtatacaagcgtcaccaacagccaaaaaggtgactgaaccaaaaaggttaagaactcctgctttggatgaaagtgtgacgggaaactttataatggagaaccaggctgtcactacctaaatctgctgatcaatttcaggattctaagagcaggacatccagacattatgcctccctatacactgtgatttgaagcacataatactactactacaaatgcttatatctgaaaataatccatagacccgcagctgtctaatagaactttttgcgattgtttacactatgcaacacagcagacactagctgcatttgaaatgtggctagagcaaagaagcaacctgaatttctaattttacttaagtgtataatcagccacctatagctagcatctaccctggagcccaccttagagctaacttactttacaccaaacacaagatagagaaacaagttaagtaacactaaagggaagcaaacagacaaatccgtactatagaacagtctacaggacaactgactcagttaaaaaaaaattcaatggcataacaatattggattaaaacagcactaaaacaaataataacctaatataaggtgtggatcttttttggatcctgatccaaccaagcaatgataaaaagacattttaaaacagtcaaagaacttgactactgcattaagaaattcctattaattttgtgaaatatgataatggggccaggtgcagtggctcatgcctgtaatgagcactttgagaggctgaggcggggggatcacctgaggccaggagttcaagacaagcctgaccaacatggagaaaccccgtctctactaaaaatacaaatcagccgggcgtggtggcgcatgcctgtaatctcagctactcaggaggttgaggcaggagaatcgcttgaacctgggaggcagaggctgcggtgagccaagatcgcgccattgcactccagcctaggcaacaagaacgaaactccatcccaaaaaaaaaagagagaaagaaagaaaagaaagaaagaaaaagaaatatgataataatattgccaattagggaattttcgtagtctttaaagatacatgctgatgtgtgtagagctaagaaaatacttctagcaattgccttaaaatatttcagcaaaaactcaagtggataaatgaagcaagtgtggcaaaatccgaatgacatttgaatctggttgaaggtaaacaggccatcctttgtattgtttttggtgctttttctgagtatgtctgaaacatttcaaaattaattttaaatgggataatgcattgggtacagtgaccaacacatagtaaacattcagtaaatgttaattagcaagtattagcatcatcaacattatcatttatgttctcaaaagtcaaaactaagatcaatcagtaaaaaatacaaagaggtagctttcagcttcatctaagaacaggctctgggaagatgaaaatacaccgtctcgtgagggagtagccaacagcatattcaagataacaataacagcagtgacttacatgattgagtacttataatggggcagatgtggttctaagcactttccatataacccctcactcaatcttcacaacaatttcataaggtaggtactctaactgtccctgctggagcagagattgatcacttggtgaggatgctgcagaagagggtcaaggtgaatggctttgctagttgccctttaacatccctgataaccctgaactcctctgattcaatgaacatgtcattcagatgaattgtgcaggttggccagctggctggctcacacacacatacagggcaattcttgcttttacttactgaaaggtctttaaacaccacctttccctttcaagtaggagactaaaacgtcacaggaatttaattatctgtaggcaagaagatgatatgatcaagaaaatgctacatttaaactactccatttacccactttcaaatttcccatcaattagaggggaacatcttccctaggcagccatttgaccaagaaatgtccgtggtatatcttcgtcaacatgtttcagaatataaatccagattacacaaactaaagttggtataaaggctgtcatcatatattatatcatttggaaagaaatattggtgaccttatccagtatgactgttataatggtaataaaattgaatctttgaagattacacttctggtcaaagtagtaaaatgtgaccttattctattcaacattgacatttattatattaatttacatgtaaaaaactgcattagaatgatattaaagccctggttagaaatgttagaaatgggaatgttcaagaacttcagaaataagatttcactttaccagccattcacagcattgagtttgtttgatgcaaattaaactaaatttccttcaccaatctctgattcggttctaattttattattatcactatctcattcatacaggagatatttttcccaatgcctctttaaacattttataaaccttaactcattttcatcatgctctggataaaaagataacacagagcactgaatatataaacctgagtcagaggatcaagccatctgcttatgacggggagagtctcctcagcccagtaaaaatgagcttagcgatgagtatacatcagatagtgcactaggtcctagaaggataccaaggtccagaggtgagaaaagagagtcagaccgccacgtgggtttcacagaatggccaccatgcagcaaaaagatcgctcttgttgcccaggctggagtgcaatggcacagtctctgctcactgcaacccctgcctcctgggttcaagcaattttcctgcctcagcctcccgagtagctgggattacaggtgcctgccaccatgcccagctaattttttgtatttttagtagagaagaggtttcaccttgttggccaggctagtctcgaactccttgccttggcctcccaaagtgttgggattacaggcgtgagccaccacacccagccaaaaacatttttttatactggtcaaaattttatagggaggtccctcccttaaatataagttttgcaaactttcagtttgggggtagaacatggaatcatgcaatgaattaaggacaagattcagccacacctcaacagattattctattttcaccattagcccaaagtccaggcttgctaggatgggtcccaactgtccttccaattttgtttctcactattctcgccagcacttcaaggttccaaccaaaattaactttttgctatgtatttcctcatatgccttagttaatattgtcttctactctgaatatcttttgactttctatcaataggttaagctaggtgttgctatgataacaagcagtcccagcatttcagaagcttgtaacaaaaaaggtttacttcttgcctgctatttgtccatggtgggccagcagatcagctctgcccatctctggcactctgatatccaggctaagagagcaaaaaccagctcaaatactgttaggaaccatcccaaggggaagagaaaactgcagggtcttacaccagaagttaggtgcttagtccaaagtgacacaattcactgccataactagtcatgtggttccaccaaaccacaagaagcataatgctaccatacacctggaagaaagaagaactaaaaatatttggtcaataccatcaatgactccctatctccatgtgtcccaaatctgataatttttccagatctaagttagattccacctcctcctaaaagaaaaccacagtccttcctgctaaaaggaaaccgttcatatggttaatatacagagcatgttattttacctcataagactctcatgactctctgagaaccgtgtctctattggaattccgtgtttcccataatgccttgctagataaatactgcttgaatgattgaacaaggctgtctgtataatgagagtttcatctccaaagacttcgaataccctggaggctagtaatacgtggtaagcaataaaactttattttttcttatttatatcataaagatacttaaaacaatattaaaatgatcataaagatgaaataaaaatgagcccatagtcccgccaccctaaaccaacaaatgttttcatttcttttcctcctggtcctattcaaagggcatccatttcctttacatagctgtattcagggtgcatacaaagagagaattctaaatagaacagaagtaactgcccagtcaacaggttttgtttgtttgtttgtttgtttttgctcttccccaagatagagacacattgggccatatcctaatactgagacttattttctgcaataaaatttccgttaatttaaagcttctaagctgtttaatacagtcaccatcattaggaaatatcagtgtagtcttcaccactacttcctctccttggctcaacactggaagaaattgcctctagtgaaaggagattgacttccaacatgagaagaaggaagaaaaggagaagtgtgtgctaaatcttggacagttctggggaacatcgtagaccaacgtcaccttgtcacggtccgacgttaagacatcattaacaagagctaacaaccaacattgaagttttaacctcattcgtgaatttatctgattattattttgctccatttagctcatccaattcttttcattttatcatgcactctttttatttgtgtagtctgagttgaaccttttctaaaacaaggtagaaaatacatacataatgcttcaaaaaaatgttttccatactgccaaataggcactaggaagtctcaccagagttgataaacaatctagatggccatttaacccactcagcttacttaaaaccaagtctttcttttttttttttttttgagacggagtcttgctctgtcgcccgagtgcagtggcgaaatcttggctcactgcaacctccgcctcccaggttcaagcaattctcatgcttcagcctcctgagtagctgggactacaggcacgcaccaccgcactggctaatttttgtatttttagtagagacagggtttcaccatgatggccagcctggtctcgaactcctaacctcaggtgatccgcccgacttggcctctcaaagtgctgggattacaggcatgagccactgcacccggcctaaaaccaagtaagtcttaaaatttgtactcagaactactttttttttttgagatggagtcttgctctgtcacccaggctggagtgcagtgacatgatctcggctcactgcaacctctgcctcccgggttcaagcaattctcccgcctcagcctcccaagtagctgggactacaggtgcatactgccatgcccggctaattttttgtattttagtagagacagggtttcattgtattgcccaggctggtcttgaactcctgagctcaggcaatctgcccgcctcggcctcccaaagtgttgggattacaggtgtgaggcactgtaccttgcctcagagctacttctatactgagaataaataaacacccaaacacctttcaatgttattaaatttcagagtaatgactttttgtctattttctattttaatagctgatagattagtaggttttcaagctatattttaaaattttatgttcagtttcctaaccactgccacatgtacacataatttatactcttacatttttgaaagggtttattattttatgtgctatagttattgatctgaatcaaatctttcttacttgattcaacagactatagtgggaataaaatgtgactatttacgaatgttaaccactgctgtaattcatatgaaatctgccaagcctattatattaggaataatgttatatattttatctaagagtctgataacacctacctcaagtctaaatattctctgaaaaatttgtcagaataaaacaagtgcccttaaataatattttcaggtataactgcagacagttgcttgtacgtttgtctttaactttaatactgtctcaatatgcatgaaacgcttgatagttcaatagttgttttcatgagttgtgccttcattaaggtacaaaacattaaacacctggaatgctgctcgaactattcctaagggagaaattttggtgacaaatgaaagggatacatttttaagctgaaaaagttgctcgctactgataaaagaatttatatcagaatattccaatagagcagaagaaagcaacatgaaaagaaaattaacattcattaagaaacagctaccatggtgcgaaacaaagatcacaaagccaaaactgaacaacaatcaaatttctacacaaaaaataagacacatacaatgcctacagttccgattgtctaatgctgtgtaacaaactaccctaaaactaagtgacttaaataacggtcattatgtactgcctcttatggtttctggagggggtggtcaggaattttggatcatctcagtcagaaggtctggctctgaactttcatgacactccagtcataccgtggctgagactagggccatctcagtggcttctatatgtatgcctgaaacctaagctaggatttgaatagttaggggcatccctctctggctccttaaggtgtttccatgtgctctctcccatacggtggcttcaaggtagccagacttatcatatattgccttgaggttcccaagacatatatctcaagctagaaagaaaaccaagaaaagccaaagttcctttaaggacctagtcttaaaactcatttggccttacttctcccatcatctgagcagctccacttttatctgtttcatacatggggctttggcataagagcatgttgaccaaaggctgtcaaagtaaccaaacataaaaagtttaaaagctagtggctgggatgaagtctaatgccccaaacttcaacaaagctaggtgatggaaaaatactgctgaggggaaggctgcttaggtgatgggcaagagagtccttggagaatgcagataatcaaaacagcacctaattaaggtacagataattgagagctggattatcactaagattgtatgtataaagatgcactaaatatcttattttcaatttctcttatttttctatactgttataatagaaataatgtaataacagcaaaagcaaaaaatagtcctataaagtgttcacatggtgaattcaatactttcacactgggaagatgatggtggaagatagtatctcaggcagtgcagtccaatggaagatcttagaaccaaatgtattgagttgaaaacattaatgctgtcatttctgagccatcttaactttggcaaagtaattaacctgtcagagtctaaatgtcctcatctgtgaaatggaagaaattatgagttcacaaatttacactgaagagtcactgatccaccattctttaattcagtcataaaatatttatggagagccaaatatatgccaggtatgatatggtatggaaatacaataatgagccaaatgcctacaataatcaatcaccaaacaaatgtttatcttaagatgacacccataaacatgtccaacaaagatagtgtcaaaaaattgatgtcacctaatgaataatttccttctttctttttatttatttatttatttttttgagacagagtcttgctctgtctccaggctggagtacaatgatgtgatctcggctcactgcaacctccgcctcccaggctcaagcaattctcctgcttcagcctcccgagtagctgggattacaggcatgtaccaccatgcccagctaatttttctatttttagtagagacggggtttcaccatgttggtcaggatggtctcgatctcttgacctggtgatccacccacctcggcctcccaaagtgctgggattacaggcatgagccaccgcgcctggcctttccttctttcttgaccttcctttcttcataccataactcagtgataattagtagggggtgaaacagagccataatacattcatttgtgaatctcccctgtcctcctcacacttaccttttctctattcccttctcccaagcctggttctggctctctcatgcttcagaatctgtgaaattggttcggagggcttcaagagaactgcggaggctaagcctgtatcataaagatttaggactaggggagaggaagcgaacacaaagaaaagttggaccatgtaagaactagaaggagagactggggagctggtcctggagtgactccagggcaccaacatgtaggggagaaatactgctgaggggaatgacatgatttctgtttctttgagagattcaagactggatttccttttaattaacatggggtggctgatctatacttcttgaaggcaactctaggtgggggtaaaccacctggggcctcaagatttattaggacctcacaatagcaaacctgttgctcccctaaaagctagaaaggggggtttacaaaggagataaaccacaggtgtcagatatgtatccaaaacatctctctgaaggacttttctcaataaaaaaaagctactgatgcatttaaaattaagtaataaaacaagaagtacctgtgcatgaaatatttttacatctcccacctccaaccctgaagccatcctattagcaacctaccctatgatcctgacatgacccgacagaaggagacttgcagatccaactgctcctcagactctcacttgcacagggggcattttcaacatgtccagggagcatttgctgccttgataatgacctttgaggagaggaaaccaactcagaagtaccttcatcctccttttagtttgtcttttatgtttttttcttgagccaatgacttctttcagacagcaataatttacacttcaggaaaatgtcaaagtatagcaatgccctgaataataattaccgccaaggttggaatgaagcctttcgaagaaatgctaagttaattagccacacacttgtttaccattaggccagtggagaaaacaaggagcacaggatcagaacatgcctgcaacatatggtctttattaatggcggcatctcaattagtctatgggaccccacttctgtcaacccagagatgatctgaataaagaaggagaagaaatgttcacaaagctgtcatggggagaagatgctacctgagaccactcaggacacccacaaaagaaacttggatttctgttgttttctgtcataccttcatacatgaaattgcctcttttaatctttccacaatgcatttgttttgggacaaaggtcaagagaagggcagattaggaaataaggaggtttacccattattaccaaaaatctatttaaaaaatcatgtttccatgaatatctcaatttatcccttctaattcttattctcatttctgaaatatatactttgtttagctttttggaaaaatccacattttaaagaagtatacaataaaaaaataatactccttatttacatgcttctgcaatcatggccgcctttccacagaacactctcagacgaaggcccttttgtgccggcctacttagatgttaccaaaggtgtacaaaaacgcatctcttgcagatggctggaagatagctctgagctctttgtgttcaatcaatcccccaggaaaaggcattagaaatttattagaagcagctccctgttctcctcagtttctgagcttggaaaaagcacactacactgaaaaagcattttgaatggaaaatgtaacctgaagtatcttacttttttctttcctccatagtcctaccatcgatatatcctttgtaggactctattagtttgctaggacgagcataacaaaataccaagtaccacaaactggctggcttagaaaagagacatgtacgatcccacagttctgaggacaggggcctaaaccaatgggtcaccagggttggttccttctgaggactgtgaaggaggatgtgttccaggactctctccttggcttgtggatggctgtcttcttgatggatttcctcacactgtcttccctctttgcttgtctgttgctatgtctaaatttccctttctttaagaatacaagtcatattgcactagggcccaccccagtgacctcatcttaacctgattacctctgtaaaggccgtctccagatacactcacattcagaggcactagggattaggacttcaacttatctttctttgcaagggatacaattcaacccataacagagatgagtaaaaaaaaaagatattaatgttcaaaaaattaagtaaccaaacataaaaactttaaaagctagtggctgggataatgtctaatgccccaaagtggaaaggtaccattgtcacatatttcaaagaggaaaggtaccattgccacctatttccctggctgtttgttaccttgatgaagtgtctactgtggcaaggcattatgcatggcactgggcaacagagggaaaaaaacatggagcctctatgctcatgaatttaccctctccttttatgccagccttttcaacctgggggaaagtggactggctagagtactaatcaagctgtgaaggactttgggcttctacttcattctcccttgcattgacagctggacagttaaaagcagcaacaccaacagctgcacagcacccaactcatcaacccacaacaacggtgacatcacctaagttagcatggaagtggccagtctgcttttgccaattctttgggacattaaacccatgataatacttttaatataattctgtgtgaaccaataatgatgacaaactattcttcttgcctggttggagataataagtaacaatacctcctattttctacgaactgtactttttttctagcaccgtgccaggcacttaccatgataattttatgccattttcacaaggtgagactgatattactagctccattttacagatggagagattacatgtcttgctaaagctaccagctaatacagagtaaaggttaaatctgaaatcaaggtgtctagaaaatcaaccccatgctcttgagccttacacaatagtgtctctttcaaccttttgaacctgagcacttatgacaactgcccagtatatgtgtacacatattctgtgcatgttatagatagacagatagatagatagataaaatatctattttctccccccaaaatctatgactaatgcaataaacctcccactgattagacagttatggctttttctcacatctccatcagtgacataacatattaagcaaaaaagtccgacccagctgattagtatttgatgtgctgaagagcctaatgtttctttatatgaaacatcagacagtggcagcctacttaattactaggttgactttatgtcttcaaaataataaaacagaataatccaaacgacaggccaacgtggtgagtgatatttgaacatctactcgaccctaaaactgttaaagcaaaagtacttatccaaaatccaatactttccatttttcttttaaatgttgtaagtcaaaaccagctaaattgattttttgcctttgacttctgctgaaaagttcattcctaagcagattacatgtgtggctttgcagctcagaggaaattttacagccaagtaaaaccctaaaatcaggaaaacatgggtttgctgaatacagtagaaagacgtgacagatcttaattataaaagaacaaatatatcttgatagatgaactgtcttttgtgaattaagactcaaaagttttaactccttgattaaccgttacccattagtaatatagaaagttgtgaggcaacgtcttcaaacttctaagtagaacagagcactcccaaagcatgcagaaccccctgtaacatcactcaacgcattttcagcatgagtgcccagggtaagccttcctcacaatgttgcaaagcaaatcgtgtccctcattcccttttctactcccagcactccttggttaagtgttttaacagggtaagtgatgacggtacaggaagagaagaaggaagaggaggagaaagaacaacaatgatatcatggtaaaggcctgtagaaattgatctaccagacaaaactcaagagctcatatgatacaggattttgcttgcacatggtcacaattaaataaatgatgaaaatgagactcaaatatagattgtatacctcattccactgttacaagctttcttctaaatgaggaatcatcaaaaccaaacagaagtgtctatcttaggtcaccttaccctcttttctgattgttgaaattaaggcagtgcaagaaacctggggagacactggaaagtgtccccatgccaagccctgtgagcacaatgagctcatgaaagaaaagcccagagccaacaactaataatcgtgcttaaaactcatcatttaagaatttcaaaataaacactgatcaattgaagttattttgacccaaagtcttacgtaccttcttttgcttgtccatattggccatcataaaaaacagcaaaaaaaagaaagaaagaaacaaagatggggagttgttgcttaatgggtatacagtttcagtttcgtaagatgagtgagttctgaagatctgttgcacagtaatgtgagtatgtttaacactacagaactgtacacttaaaatggttaaaatgatgtattattccattaacttaaaatggttaaaatgatgtattattctcaggtatgataaagacatacctgagactgggcaatttacaaaagaaagaggtttaatggacttacagttccacatggctggggaggcctcacaatcatggcagaagacaaggaggagcaagtcacttcttacatggatggcagcaggcaaagagagagtttgtgcagggaaactcccccttacaaaaccatcagatcttatgagactcacccaccatcatgagaacagcttgggaaagacctgcccccatgattcaattacctcccactgtatccctcccacaacacgtgagatttgggtggggacacagccaaacaatatcaaatgataaattttatgtttttttaatggaaaataaaatttaaaagaaggaaaaagaattctctccccttccctctctccctacctccctaccttgctttctcccctccagggaagacatgtgcctccaggatggaaacaaatggattgatctggaaaatacttaggaggcagaactgaaaaaatttgaatgtgaggatgagaaacagggagatcatgggtgatttccaagtctctggatcaactgaaatggagaatggataaggaggaacacctggaggagagcacgcttggaaaggcatggtgagtttcatctaactagagatcaccagcaggagtctgccctgtccatctggagcccaggaaggagggttagggtggagattctgtacatttctacagccaactctaatttttggttacaatcaaagcctatgcccttctaaaacctttttcttccatcactaatgatcagctgtgtttccagaagtatgaatggatttatcctatatttctgcctaatatttcatatatgaatacttctaggcaggcattgggtcatatgtgtaaaacgaaagcaagtacttaacacaatagaccattcaataaagctgcttttcacatgcttcatttactactttccattgcctttttcgcaagcaattaccatctcacacatgcccagtttcaccattctgcagaaccaaatgttgaatttaggcaaacatagggtgttcaataaacaggtggattttgaacagaacaccaatgaattcaggaagcacggtcaaccagctgcgtctgtcaatggaataatcagtagctggctgcatctgtgctggctgggctgccatcggtgtttacaagctggaattgaagagggctcggccagctgacagcagaagtttgcgcagcacctgtctaaagtatatatgactgcctccaggcaatcccattagttctccactttcatggacactaggacttgttcacaaatttagggggaaaaataaaaaagacaaacagagctagcctctgactgagaaaggacacctgaaagagaaacaatcccatatggagaaacagaacaagggggtgagaatgagaaagacaagaaatcactcaagaaagccagtaatgtttacagatagtagaaaaattttgtctgtaaacagtgggcttggtagcatttttttaaatcagagatgttctggagaaatatgtaaagaactcagcccaagctttctgatgccaggcagggcataagtagtttacatggaaccttctgacttgtttatctgacatagtaaacagctttctctgatcccactgtcccttttacgcattacaagataacaaaaagttatgcgattttaggaaatcaagtatataaacagggctattctcagcacatccactgaatattaagtgcccacttttatctgctagaacttgatgtgtgaaggtaaccaacttaaatgcactgaagagattgcattcacacagtgaatagtgacattttgctaggaatttgttaaattttataatgcaagcatactgccgtaatgttccacaaaacgtaacagtcggtgcacagcaatactgccctctggtttgtgagggctatttccatcctcaattcattctagcaggaaaaagaaattaaagatatgatagaatgctatccacattgttataatgctggttctttctgaggttagtggtcacacacagtgctatagaggcggttgttctttcttgtgcctgtaactgctgaggttaatctctcagtgcttccaaatgcatatggacatttacacatatggacactgaccaatcctaaaagaaaactcaggataaatcatgttcaacttcaaaagtccagcagctaattcaaagccatgctcttgtagaaggagccattgaaaacaacagagaaaccagacaacagtctttaacgtcttatctttgtttatgattcttaagaccacacctggcgtgaaccgatatgctaggtcaccctggttcctcaggtgcattaggcatatgtgagcagtgaaactatgacaaccagaatgcaacatccaattataatgattagaataacaacaaacacttaggcaataattatttccattcattcacttcatctccccaataactctacgaggtaagtacaattattattccccacttcatggaccactcagtgccatactaagagtcccagagccagtaacgagcagactagatttaagatcaaccccatctgacttaggggttctgctcttactgttgttctgtacctaaagctatctgatgtattttaaaatgtaggtgtatcagtttggtggggttgccataaccgtgagttgggtggcttaaacagcagaaatttttcttacagttctagaaactgaaagtccaagatcaaggcatgggcaggtttggtttctcctgaggcctctctctccccttggcttgcagatggtcttcaccgtgtgtgcaccttcctggtatgcctttgtgtgtcctaatctcctccacgtataagaacatcagccagaccagattgggacccaccgtaatggtttcattttaagttctctctttctttgttttcttcttttgagacagagtctcactctgctgtccaggctggagtgcagtggcgtgatctcagatcactgcaccttctgcctcctgggttcaagctattctcctgcctcagcctcccgagtagctgggactacggacatgtgccaccacgcttccctaattttttgtatttttagtagagatggggtttcactatgttagccaggatgggctcgatctcctgacctcgtgatccacctgcctcggcctcccagagtgctgggattacaggcgtgagtctctacgaccggccttaagttctcttttcaaaggccttagctacaaatgcggtcacattctgaggtactgtgggttagggcttcggtgtgaatttttggggaaaccacaacgcaccccataacagcaggtgtgttaacgttctacaaaacgcaacggtgggtgaattgtaggacttccctctgctttatgagggcttaattgtatagggccttattttggatctttccacattcaacaagttctgagaatgtgatacttggaaaccatgttcatcagaagagtgaaaggctttcaggtaaacgtcctttgatctttttcaccgtgatgccctccgatgacattaactgtggtagtaaccagcatcattcagttgctgttttagaaggaacttaaaaatggaagatttgaaaacatgattgtgaaaccataattttgcactgagtccagtattaacagtttttcaacagagttaactcttgctgctttttgttttaaccctgagtgtctagaactgagttgggcaagctccttaacccacagcacaccagcagcctagaactctccaagatgtcacttggattttccttctgacctgcctttcctgatcccttgctacctcaccctatagacataggcttacttttccctaatattttcctgtactttaacgcatagctgtgtttttatgaaaaataaaatactggggttttatgctcaacttatttaaatgatatttcactacaaattatgttcttcttctatttgtttacatcattatgcttttgaaaaccaccagaatatgtatgtgtacctctggatctaagctgttaaacatagtagccactagccacatgcagctaccgggcatttgaaatacggctcatgcaagtggaaaactaaatttgtaattttaatttatctttaatttaaatttgaaaacctgtatcttaattatgagaatacttttaaatatttttggaatatcttgatgaatcttcttttttcagttgtacattttataaaacttaaatatgaatcaatcagttccaatgaaaatttagcctctgatttaagatgtactataaaatacacatcagatactgaaaatagtacaaaataggaatgtaaaacatatcagtaagttttatgttgatgatatactgaaatactactttacatatattaaataaaatacagcattaacatgatcacctaattctttaaatttaaaaaagtaaaaataaattttcttggtacttttttgtgtggctactaaaaatctttaaattacacatgtggttcacattatacttctaccagacaggggtgatctaggttttaattcctctaactactacaagtattctataataagcataaataataattttacttcattctcttatcagcaggcaaatagattgtttctaattctttaccatatcaaacaaccctccaaattcctgtttttatgcatcctcactaatacttattatgatctttcttgttgcttttggtcaacttggtggttatagagcagtgtttcttatttaaatattcatgtctcagaatactgaaagtgtacatattagccattcaaagttcccctttcgtaaactgcccatttatatctttgcttattaaaaattttgaattcacatcttttatttaccaattagtagaagtaaaaagatatattcccagtataaatctcttgtccactgttagacgtaatttttcagctattatacgtatctccaatattttcttagcttgtactttgttcatttttcccatagtttatttcattgaacacaaatctttaattataattaaattccttaaattttacctttattatttcaagaaattctaccctagtaagaaattgtgaagaaatttcatcttttctactcttggtttatagtttcgccttccatatttggatcttcagtccatcatgaagccctatagcacttagagcagcagatggttgccaacatcctaggcttaggtacttgccatttgagaatctgaacaaaactgaagactttcttactgaaagaatgtatgtgcataaaatactatatatataatttcaggctgttcccagacctctactgcaagccctttcatgtatccttatgcagtccacagaatccaggcgcaggatccccgagtctcacagattctactctctattcaaaaacttcattgtatttttcatggctttgctcaccatctttttctgggttatctcatattctcaactagtttatgagctccttacggacagagacctagatccaggcatctccaagatttttcatggcacctgagagctgggagtgctcaataaatacgccccttagcaagtgatattccagaaatcagactcagagaagagaatgtggtgtaaggcccaggggattactctaaagaggcctccattaattcatgcattcaatcaacagtcattgagcttgtccactgtttcaggtcctgggctacatggaagataatcaagggaaaggccacagtttgtgtcctcagagggttcctattctagaggggacagcaaaggagaagtaattataacacggggcatcaatgctctgctaaagtaaggaagtagggagcttctggtctgcataacaggagggtacctaatggggcctttgaggtaggggaaggttgggcctctcagcaggagtcatgtttaggcggagactcacaaaaatgcatagtgttaaaaaaattaaatttagcctgaggctgtctccgtaatttgagtccctacctaaggaactgcagcctaacctaacttagtctattaaacacaccgaaagcctaatttaggatgctttttttttttttttttgtaacagcagctgagcttcagccaatcacaggctgccaactgatcagaccatgaccaaataaggtgaacacctagacataacttaaggaggaggcaggatttgactgaggaggcagggctcggacaccagatcaaatcaaagactacctagaacagggacagagtggaagtacatttccgtaagatatgcccaccactggtgccatgccactttatctctccagcacttaatagattctacctgaacccctcaccctcaactgctattaactgaacctggaaatctgagtatctatatctgtagtgcattaatgattctatattttgcacccactgtgtattaatgacacaaaagtggaggtttcccttcaatgctttgatccaactctaagctgccaagtccccaaggctgtaacagtgtatacaggattctacttgtgagcaaggaaacaaaccatatatggtgacttctctcagataacaacatacaggaaaaaaataaaacaaacaaacaaaacaactgcctaatctgggaaggtaggagtactgacccactctgtgaaacaaagattggttgggtatctccattggaacagggcaagaatatctctacagacccaatttggcagcaatggatagatatcagatgttgtggagcctctatttgcaccccaactggactaatttttgtttgtggccattaatggggaaaagtcataccccatattcactcttgactaccccatgagccacttgtttttaggagtggctttcccttgtatataaaaaacttggaacagaggtgaatgtaggatggccactcttgcttctctaggggtcacagtctataatcccataagaaccaagaacaccagaaataaacaagcaacagcattaattctagcaggaatcagagcagcaatagaacgagtggcatcctggggcagctttgcctatcacgagtacaccctgaaaaactagactcaaactctagaatccctagccaccaacacaggtcatgtactaaagggaatcctagagtccttagaatctttggcaaatgtacttcttggtaactcattctgagggctgcccgattagttgactgctctttggtcaaactctgttaaattaaacttgtctacagtttttcttttaccagtaggcagctcatctgaaaacagtaggagggaaaagagggaatcctagaaatcgatctgtcataaacattgtgaactggctagagtgctcctgccttttcctgggaatcagaaagtagcagccagacaggaaaccaaaccacctgatcttttacaaacaggaatcagatcactgtactgccacatttaaagccaccaggggcatcccatctaggatgggatgggaaaaagtatgtctaaaatatatatacatagtgtatataaatatatattatatataatataaatagtatataaaatatataagtatatattacacatataattttttcttagtataagtatgtcccgcgtaatatttgcaatgtaacttacactaacaaagtatgtgttatttatcagaaagtcaaatttatggcagttaaacctgccagcccaaagcacttaaaatataaaattacacttaaaatagagtcttcagtattatattttctctggctttcatcttagtgtgagctctgcattgttccccatgcttcaggcatgctgaccagtgagaatgagaataagaatgccaagctccatcccatcttagcaccttggcttctgtatcttctttccatttagaatgtgttttccctctttcttagcgtggttggtttcttctcttctttcaaataccagtttagatgtcacctccatagagaggccttccctaaccacaccacctaaagtaggctatcccaattattttctctctagatacatatatatatgtcagtccataaacattttattctttcacttctaaactgttgccctcaccattatgtcagagacttctgccttttgcatctttgtgtccctagcccttagcaaaatgtctgtcacatacgagatactcaacaaatttttatcatataatggaaatcttaagttagtattttctctggtgcttccaagacatgcattttgcctagacatgttattgttcgtcatgtgaactggctatggcaaaacacattgccttcagagagaaagagccacacaagttggaaaggaaaggtcacaaggatgaaagaactctatcaacattaatgccttataaaaaaatctcttaagagataccaaaagatggaaagaaattgagtctatcatttgaagacatcccccacccccgcttttttgctttcctgcaagtcatatctgagtcatacctaaggcactttggctgtgcctccttgtggtcctctccatttcttactacttcatctcatcactttaccaccttcaaagagtcctttcctcatataacctcacatgatgttcacaggattaaaaaactccaaacgttcaatagagaaacaacattttcttaaaaatatacagacagacatatgcgaattctttcaacatgcttataaatctatccacaaccctactcagagtatgcttcaaatgtaaatcagaagccatatatattgtattcttccaagtgattactctggaaaagaaaaatcacacatatttattgagaggagaacaaatttaataattttgctcaatcatcaaaaacatttctaaatatgagctatgataggaaaaaaatcagtttaactttacatatgaattattttcctgttttaatcatagaattttttaaagttttggattagattcaaatttcttcagagaactaaatgataagtttgcaaacaattactggaaagaaataaggacaggtgagagcaaaagaaagaaaaacggttacagagtgtaaaactattttcaagcacaaagttaaaaacttctaatacagaacctggaaaacactttatgtgtgtgagataaatgaaagcgttgaggtcagattagaaaaacaaaacaaaacaaaacatagcttctactgacaaatgtaaatgcaccctgtgatcctgttgccaatgaagtggcattgctctgatgtaccactcccatcccaacccaagcacacacttgtcaatgagcaccagggttttcaaattatccagaactctatcataatgatggagctaggaagttctttcagcctcttaacagcagcgcattattttccctatagataatactgagaacatggcaacacttctgcctgatctgcttattaataatacccaacacagcatttattagatagagaactactagatgttaggtgctgggttaagcacaggaaaagaatcaacaaattctacatcattttctttgttgtgttggtggtggtggttactgttgtttataccttcagatctctttctacactaaatttttgggtagaaatgtttaaatatcatccttagcctccgcaataataatagcatttcatcactatcactggtgagaaatttgtgttttatttttgtttacattttacattaagaaattaatgaagtgggaatggctacctttgctgtatactccaaactcccactgatctgtgtgtgggttgcgtgtttgtctagagaggacagttgcccaacacaggaaaaaaaataccctgtcattatatgatttttcacagaactaaaaagaaataaactacccccattccaaagcgtggcctcctatctttttgctacacctcatatacttttctcacatggcaagaagggtacccttgactgctcagtgcctctccctcctcttgatgctgagatgctccaaaacaccactggggttcttcaggagggatttcattgtcaactccagcttgcagtacagggaagtgacatctagagtgggcctctttttgtcactttccccatactaccacacacataaaaatgcctgtcaaacactgtcctacatacatggatgagaaaaagaaataagcactctactatgaaagactctaactagaaaaagcaaggagatgccaactgacaaatgtatggtgatggactttctttttttttttttttccaattctcagatttatttctgaggctctcagccaatttctgtgtcataaagatggtgcagttcagagcttaattgctttagcacttgcaccaagaaaaactgtattgcaaacaatgaagaaagaagagaggaaaccaacattttctaggcactggccacgtggcaaccagtgtacaaggcatttagagaaagctttttgattccattcaatcctggaaaccaacatgttgaagggccagatttttcaccattttatagggatgcaaactttagctcagagaggttaaatgacttgccaacagtcacacaactagcacttagaggaacgggaaggctaactcggagctgatgctgcagcttacactcactccccactcccacgcaacacaaactctttctaggcagcttcgaaggtaccaaacaagtggctcctaaggactcagtaaacattcctgtcagctggccaagatgaatattttggataatgtccagacacgtgaaataccagctttaagttgtggaagtgcttcaggcacaaccaagtctcatttacgtcctttaaaaaatagtcatgacctgcccccttcacacactgtcattcttctggaaggtatctgagagcacagctctgcaaatgccaagagcattatgcagtttccatacatagggcttcctgagtcaggtttggcagggcaggggttcagtgtacaatatttctgccttatttctttaagtttctcttggctacagctcttaagagacacacagagggaatggattctgtagaagatttctcccagaaattttggtgtagattagaaagcttggtttgcttctggttctattacttgagatttatttggaactaaaaggttttctgcctgagagtaaccatttaatatattggggaggggggaagaataaaatgctccttttgttttgctatttgcaccaccctgtcccgattctattgtttgcagtaagttttgtaagagaaactcttctgcactccttattgtgttacaagtttagatgtacccaaaccatcagcagttagattccaagtatacgcttttgattgattcaagtgcattacccgggagggtgtgtgctttgctctgttgttcttccagccaactcccttgccagctgctgaaatgatgccaccaccggtctccatgtcatgcagattttacaccctgataccaggaaagcagaagcatttctcaaaagactttttgctggcttggcaggaaaacagaaattgctttttatcaaaatgaaaaaggttttcttcatgggaaacagcaaaagcagtttgaaagaggggccaatacttttatcctagataaggtgttttcagcagagcagacagaaaaacatgttttccttcctttcatgacatcaatcagatccccaaagccagctacctttattcacagaacagatggagcggtaatggtcccagaggccactcttcctggtctggggatcttgccatccctgcctgaaagttctcaaatccaagctctgggaacttgggatgcttttttctgcctctcccacactccaagaggaacacatccactattatgcatgtcttcattctttgtcctgggtggaacttctgggggtgggagaatgggtgataaagggggaagtgggattcactttgtgaacacctactagaagccaagccaggtacatcctatgcattatttcatataaaccttaccacaaaactttgagtggtattattatgtccatatgacagacgccaaagaagtagactaggggagttaaatgaaatcccaaaagtcatatactaatatgtggaatactagtaaaatctggaatgtgaaccctgcctggtctgttgcttcagagctttgatgtgccaccaacaaacacttccatgcctctctgcttagaggcccagtttaaaatgctatcctctggataaatatgtggtaggtccatacaatggaatattactcagccatgaaaatgaaattctgacacgttacaacatgaatgaaccttgaaaacataagctaagtgaaataagccagtcacaaaggatgatattgtgattctgaaaccaacccaataatcccatagatagttttttggatagacgtagaaattgacctttgtggtcttaatgcttgaagtttatatttgttttaactgagttccttcctcaggaaatgaccttcaggcctctcgaaaaaaaaaaaaaagtattggcaaactgaaactcaccagatcaccacattttgacaatgagatgctggacccctcattctcaggattgcttccttgcctctccctagttcctgttttcttatacattattacatttcttcctggctatataaacccctggttttacatagtctggttttggtcagggaaatggatttgagactgaactcccttcttcttggcaatactcatcatctcagtgactggttttctgcacggcaaacagcaggacctagaccgaacccctagtgttttggtaacaattccacttctgtgaggtacctagaataggcaagcttacagagacagaaaagtagaacacagattaccaggggctgggggagggagaaagtagtccggggaatagggagttattgtataatgagtacagagttgtgttttttttttttttttttttttttttttgagacagagtctcgctctgtcaccaggctggagtgcagtggctcgactcgatctcggctcactgcaatctccgcctcctgggttcaagcaattctcctgcctcagcctcctgagtagctgggattacatgcccagctaatttttgtatttttagtagagatggggtttcaccatgttgggcaggatggtctggatctcttgacctcatgatctgcccgcctcagcctcccacactgttgggattacaggcgtgagccaccgtgctgaccgtgtacagagtttctatttgagatgacagaaacttctggagttggatagtgtgatgactgcacaacattgtgaatgtactcagtaccactgaatgacacagttagaaatggttaacatgctaaattttatgttatgtgtagtttgccatcacacaaaaatgttccctgcttttccctttgaaagatgccacatctgccctgattccaaagctctttcttagaattgactcccactagctgtaaagtgacacaaaagatgatctactccaggcatgccaactcaaatccactgatagtgacagctagcaacactgtgttaagaaagattatgaggatgttttcagggccaaaaaagataaataacatgatcgatttgtaaaaatcccctcacaatgagacatcgaaatgttggataaaatacaacaaaatattaattgttctgggaaatgtgaattgggaaacacagaccaagtggcaaaagcttgggcagagagtcatggtattcagaggccatgatggtcaaatacaggttgatcttctaaaaacataggaaccgagtgagtaagaaaatcaaggcaactaaaacgaagaaaatgttacagtaggtaggtagtcaggcgtgatggggcaggagagggccctcccaacacccccaccaggaaagccacgctaccatcaggtgatggtcaggtggttgttaactctctttaaaataataatttgtcacagccagcaccagggaaagaccgtcttcctatattgataggaaacacctgtaactggtaatcagcagttttcaggagttgggcgagtgagcacaagcatgcgcattaagagacaaaatggcagaatatggttttctggggcattccactggaaaagggaagaaagcctcaggtgggcatacatacaacttcttaaacacactcacatgctcacctcccacatgttagcaggccacacacatgtgggtggcccaccttaagagaagaaccatgggaaaagggacacaaggcccagaagtacaacaacatataaaacccacgtcaaaaggtcaaacgttacatgtgaccttcacagtgcctgcttgggtctcttccagatatactttcctttctttcctgtgctaaagctttttaataaacttccactcctgctctaaaacttgtctcagtctcttttcctgccttatgcccctcagctgaattctttctcaggaggcaagaactgaggttgctgcaggcccatatcgattagccgccagtaacccaaatattcattgcccccaacaaaaagagcagaggttttctgtgcctacgaggttcatgaatgagggctgcctagagctccccccattcttgttgggtctccccttctagtacaagactccttgtagctttgcaataagtttaccttttccttataaaactttactagctattcttcaaatcgacaatggtttgacttcaacaggtcttcatggggtgatcacatcatgtgtcatccatagagggtaatttgaacttataagcattaaccgtgctccatgagttgttgttttttgttttgttttgttttccttttgctttgataaacaacatacccagatacatgggggaaaaatggtagtcatccaatttcttcatattgccagactcacagcaacaggaaagtgacgttattaaccctggggagcctctataacttcttaaaccataaacaaaaataaagaacataatggaaggtataattggtgttaaaaaaaaaaacccaaatgttttctgaattccatcctcatgttacacactcaaaaagtttctctgtaaagaaagaaaatctttgactcaagaatcaactttctagctatctcaaaaccaaattataatgaatttagaccgtagaatcaatactgggggactaactaaggatcactaaatcctgtgttattgattgcttggagaaaactatctttttaaatatgcatcacataacaaagttctttatttctaagaactttctccaaatcctcccatcacatggtttatgtaatgattaatcctttgtattaactactttatgtgtcagaaatattaaaatgcatattaactgttcctgggaaatggttctgcagtttctcctaaaagtatactacctactttgaataagttacatgaaaactgtggcacatttgggaagaaagcagcttagtaggagaaaaatgagatttgcaattataagaactcaatacatgggtgtcttaggcatttccagattttaaaaaagtataatgacttttctcccccagtgtgataccaaaatcaatggaatggttttggtttgttttctactggagtgtaccagttagatttaatcacagagggaaaaatcttgttttgatttctcttattaattacttcttggaaaaatgcactgtagcattcttattcagaatttcaggaacaaaaacttttcacttttcaaactgcaaatgaaggtggggtaaatgtgtgaaggagctaagatctagatatattagagtttctatctctgaatccaggaaggactttgtttatagtggtggaaatcaagcaaggagctattggttggtccacacaatgcctaggtgttggctgtcatgctccattcagacccacaatcccaatgaaacctgtcactttcaagagtgcaaataataggatggggaaagagtgttagagtaggacgttttctaacaagagcccagtggattcctacctttcatctaataaatttcaatggtttaagagagcagatccataggtgccacacagcgaaaggacctgtgtaaaaatcacagtgagactctggagtaagagatggaatgtgatggcccgaggccctgccctccaaccttgagtccacaacatacgacctctttaaaaaactccctccagaagccctacagtttcctctctggtttgcgtcttactgctgaagagtctgtttgtagagatggatatctgactaagctagctttccttttttatgctctttccctcaagaaccaagggtttttcacattccaaaataaaatgcaaactgagagcattttgtatttttgcatttcgattccctgttttgtcagtgagtaattatagcaaataaaatattgcagctgaatgtaaattgttaggcaaccagatcacagcaggatatttttcttccacaagttttacatcatagagtgttaaatattaaaatattgcaagtcaagtaaacagagagggttctttgctcaaaacattaattttaaacaaacatttcactgttattcagatcggatgctaggaaacaaatgacattttctttcaaataaggtgaatagatcatatgaaaggaaagcagacaagggaatcatacagaaggaagggcatttatgacacgagagatgaatttcagccagaagaacaggagagaattcacatgtaggagagaaagcaaaagaaagagaaattggcaaaacaacatggaaaagagcaagaaatgagaaagactgacttactgctagaaggggaaaaaatgaagatacgtctcatgtcagagtacagagacctgactcaaaataaggcagctggggaagaaatgaaattctttctaacatcatgaatttctgtttccttaggttattaccagaaaggtagaaaggagatgaattttcagacctccaaaagatcaccaatcaataaaataccaatcaataagcattgattgagtacctaatgtgtgctcaacaaccaagtacaaaattagacatggccttcttctgaggtaccttactatggagttgagatgaggagatgctgaaacaatgaatgagagtggaaatgtattctatgctgtggagtgaagaaaacacacagctcaggattcaatgataatgacaatgagggtggttgagagtaactgtcgtaacactcttattttctaagcacctcctacattccaagtactgtgctggatgcttaatattttcatttccaacatttaaaacaatccattaagaattatctcctctagtgaagaaaataaagcttcaaaacttaagttgcttgtattacacaatgagtaaatggtagggcctgaatttaaccccaggtctcccaacccaaagatcacgatctttcttctactgaagtgctggatttatcctaagaaggcattcttctgttaatccttacaccagaatgccagctaattaaaacagaaacaaaaacaaacagaaacgctgtttgagaaatgttctttgtaagggagatgacctaacatgaatttttggatgaaattataatggatatggaggagttttgtttttttggtttgagaaagaatcttcaggaaaacatatagaatttgcaggagagtcatgttcattaaaccatctcagagttaaagactggagggaatagatgttaatagccataaaggccttgcagaaaaaggcaaaccttcttttccagtaggagagaagaagtgaaaagggatggaggaggagaagagtcaactgaggagcaagaaatgttccacaatgagaccgcttcacaatatctcccagttcacaactaaattaaaataatgcctggggagaagactgttacagatacatgcaaacaaattgcacatcctgttaagtagggcaaaacagacacttggacagagaaaccagaggaagacaaaattcacagagaaggtggagagaactttaacttctcatgaactgtggaattggtagtttgagtacattatagttagatctccattgagcaacaaggtcccgactgacatctggtctacaagatcaactttctggcaatacggtaaattttttgacagttactaaatgagactgaatataagcaaaataaaaatcatcttgtgtttcaagaaactgatatactccagatacatcaccatagcatatggagatttctttaactagaaaaaatagtccatccaaattcacattggttgaggaagccagaacactgacttatccatgtttaccacagctcatctgccttccctcccttaataaaagcagaggcccagagtgactgccaaacaaaatctacctaaaaaacatgccattcaatttttttagaaggccattgaaagataagcaaattaaattaaaagaaaggaatgaagagattttccttctgtctggttgttgagagagaacatttcttgcatatccagcatttggcaatctcttagcaaaatggcaaattcacaaaccctttaacccagcaaatgcattgctaagaatttgccctacagatatacttccaaatagtatgccagaatttgtgcaagaatgtcctttgtagtattgcccataaaaacaaacaaaaaaatggagaagaaaacccatataccatccattgggttaaacgcgttttgatttatcaatacaaaacaatatgtacagctattaagaataatgaggtaggtctgctcttcaagatatactatgctttgaaacaagctaagtgtgaagaatgtatataatatgccatttaagtaaagattttaaaggctccgtgtcgttttgtttagatgtcaacatgtgcataatttctttttctgaaaagctacagaagaaacttcacaatggtaatatttggaggacaagaggccagcatgtcagagaagagaaggaaaggaaagttttcattttcctcttatacctttccttcctgcctgaagttataggtatggctaatttgatttaaatcaataatattaatgaaacataaaagtaaaataattacctagtaataataaaactatgttgtttataactcttatttgatgtttggattctcagaatttacttcactgaactccgaaatgggtggtatttttgaaatttttagctgcaatgaaagaacacagtataactgatgcaccccacccccaaccaaaccaccctcataccttgtccaccactgccatctctatcttgcatttgaaaatatgcagagaagactctgtttccatgctacagacagtacttctagaattttgaccgcatagtaaacagtcattgtatcatccacaccctgaatgatgagggacagggacagacagaacctacctaccatgtgagcagctctagagctgtcatagctatagctgactctagctcacaaagcagacatgaggaaaagcaaagtttgcatgtgcacatacacacaacacaagcacactgagaatgaaggagaacaatgtgagactatactggtcaaagagtatttaggatctgccaaataatccagttttgtttgtattttcatttacatccctttcaccttaaccattttcacagttatcaactctctaatacactgacacatgctgtgttaggcacttcgcaagtattatctcatttacttctcatttaaaatgccattggttaatatcataatcttcccattgcatatgaagaaattgacacttaaagatataacacttaccctactcaaagtcacacatctacatctagcaagtgggaggtggcattcaaacataaacacagctggcctcaaaggcactatgactcactgtattcattcctgattcaagtctcatgccttgccctgagactgttctttaggacataaattgggcaaagagcaatcaactcacaaaaagagaagaccttccagaccaaaactaggaagtttggaaaaatgagaatcatgaaaatatgcgtattacacatacagccaggttgaagaagacagaaagcattagaatgtggaggaaccttatgagctagaatgcttagtacttaaagaaatgtctttgggatcagccatgctcctgggatgaatcctgacctggccatgatctaactgtcaccttaaccatgtcaccgagaggcttaacctgcacttacttctttcatctgtaaaatggatggcataatagtgcctgcttcacagaggcatggtgagggttgaataagatcatgcacattaagtacctaggacccagtaactctctgtaattatgctgtgtttgagatcataaagctcttaatcattataaaagtacctgagaaattctggaatgctataacaggaaaacttctgaaaatatagactacccctaggcaagccctttgttttacacagcaagaaagtgagacctaatcagttagaggcaagatgcttctcaagtcagtctattgagtttttattttgcactgaattacacatctacagagcttcctgtagcaggaaactctgctcagtttgcccattgctcattcctaacacctttttctcctgcctgttcccatcccatggccaactactcattctctcagaccatcttgaagccagtgaaaatctgctggggaatactcgggggaagcatatgattttccagtagcaacactgctgctgccacctctctccctttcttcctaccgtgaatttgatcatggttccaggaaatagggtggccatcttgcaaataggcagattaaaacaatcactaagacactgcctacctccaggaggtcttcttgttaccaaagaaaatacacccctatttttttaagcaactgttaaaggcagggtttctgttacatgcagctgaactcattcccagaaaatgatagaagtcctttttccatggacattgacacagtctaggatgggatggtggggatagtacagggtactcaccagctgttggagggaaatccccaggttgtgagagctcttttatttaaaaaaaaattaaaatgtaagtcaaactcaggcttagttttgaagttcatttctcaccttgttctcatttttatcttgatactccgaatgaatttcccaacgatatctaagagcttcccattcccaggctggtccagtgatttttagtgaaattaggttttattgaaagtgagttgatttttacttattaatgttctgctaattagagcactttgtcaatatctccatgcatgcattatattctcatgtccacagcatgtgtttagaaatatgtggataacaagatggagagttagactgttctggccctaatgacctcccgccctctcaaaacgccaacataacttctggtcacgtaatcatgggccaccttgtactgttcactgactatttgttataggttgattttaatccctgacaaattttttttttttttttttttttttttttttttttttttttttttgagatggagtcttgctctgtcacccaggctggagtgcagaggcacgatctcggctcactgcaagctccgcctcgcgggttcacgccattctcctgcctcagcctcccgagtagctggaacaacaggcacccaccaccatgcccggctaattttttatatttttagtagagacggggtttcaccgtggtctcgatctcctgaccttgtgatccgcccacctcggcctcccaaagtgctgggattacaggcgtgagccactgcgcctgacagacaaaatttttaaacctgtgaatactgacacagcgcttcatgttttgctagtcactctcagtgcctatcacagaggtaggcaaatcaaaaattctcatgaagtactagaaaatagatgcacctgtcccccaaatgcacagcataagaagatacccagggactaaaagctcccaactccaaaataaacctattcatgaacatgagtctctattcctttgctcagggaattcagtgctaaagtagatagcaaatatatttatattaggggaaatatctaaaaaatggcacttatagatacatttgctaaatagatatggaagtctatctgaagacctagcactatgccagccatacaacaatctcttcacaaatatgtattgaatgaatgaatgaatgaatgaatgaatgaataagcacacatacacagcagaaaaacagactatgaatgaatatatatcctttcccctaaagaaagatactctaaaacaaatgggcagtcaaaactacaatctctcatttaactgggaaaagtaaagaaccctctatttcatctttgatttcctccttacatgatgtacaatgcaaagggcttgctagtcatatttgtcaagagagcccacaggtactatctggctcatcacagcttaacttatcaattgccattgttgtttggtggatattgatctgggaagaccttgtatcttgcgaaagtcacttctacagcaactcatcactttttctttttagtcgacatgaaggctcaagtgttgtggtatactgggaatttccacgcgacagccccattccatcattaaatacccagtgagagcttgttaactagatgaatgtcccaattaaaccagcacgttcttgtcgctgcctaacagtgatggtgggttcagactaacagtttgaagggcaataactaaaatggtttgaggagcctcaagtgtagtttcaatggtttcacacttatccattcatttgttcattcaacaaatcactcaggggcccagcatggtggctcacacctgtaatcccagcactttgggaggccaaggtgggtggatcatatgaggccaggagtttgagaccagcctggtcaacgtggtgaaaccccgtctctactaaaaaaacaaaaattagccaagtgtgatggcacacacctgtaaccccagctactctggaggctgaggcaggagaattctttgaaccaggaggcagaggttgcagtgagctgagatcgcaccactgcactccagcctgggcaacagagcgagactctgcctcaaaaaaaacaaaacaaaacaaaacaaaaagcatttttttggcaggtcccaatgtctatttccaagctgaaaatgtttgctttcccaaaggggcataaaactgtgatttttcttaacagcacagtttaagtggtcttgactctgcatcttaagttcccagggttaagctggagatcttgagaacaagaaaagagtaaaaatagcaacagtgcaaaactccagacatcatgttggctccatacggctgtgtgggttgtgcactgtgcaagttcagtgtgttccattactaggaccatgatacaaatggcagggaagtggtagaaaccccacccaaggggtatcctaggcccatagtgctccctagtacaagggccacaaactactaaatgtccaaaatcacaagtaaaaactgttcattttggtagaggaaatacttgatttcatacacatctaaatttcacaattaaagtctcaaataaaaagctgccaagtaaaaatgctcaatgaaacataattttttcctctacctgatttttaagtaaaacaggcaaagaagaaacaaggcaatgattgaatagaaatgctattcttgttttaaaaaaaattagacggtcctaagaatctatgctaaatgattacattaatatgcataaaatacataaaacatatgtacaaggatgtttattgtaagactgtttctctattactaaaatacagaagtggttatataaattatggtacttccatacatgaaatgctattaagtcaataaaaagaatgagtaaacttgtaattgctatcctaaggacaaagctccaaaacatactctgaaagacaaaaaggtaatcatagaaaaatataatatgatcctgtttataatcaaatctagataatgtacataaagggatattaagtcatgaaacagtgcttggaaagatacacaccagtcatctgacagtaataacctatgaagatgaacgaggaagtagagaaatttcatattttatatattgtaatttgaactacttttttttaaataatgaaaagtgtttgtgtattaagtgtattataaaaaatatccaaatagttcaaaatgacagtaaattacaggttatgtatagtttaatcccaacctgttacaattcatgacaaaacaaatggtttaaagttaaaatttctaatgtaacctatgtcaattacacattctgacaacatatattcattgagcacatacattacataaaacactgctccaggggctgcaggtccagcaaagagacaggtaaggcccctgcttgtatagcgcttttgtccaagacagtaaaagagactcatatattttaaagagattttcagttaaccatcattttcatagtaaataattcaactaactatgacattttgggcactgtggctgagaggtttgctgtgactctagtaaagtttcttcttggaaagacattctgtgccataaagagcattccctgcctatcaaatattcatccttctcagccatcaatcaactgaagttccctcaaacagaatccataaaacagtcatactttccatccttagaggggtttacacctttccaagcactttcacacatctacggtgtcctaagagatgggtgactaagatgcaggagcaaaataatataaatttaccatataaaaactttcttctgtctagcacacttttctcctcgctctttactcgctcaagttttgctggtccttcagtttgcaacttagaagtcacctcttccaggtggcattccaggctggtatagggatcccccctacatgcttttattgctccctattgcctccattccctcacaaggtgtggaccatgctgctttgcaatgaccaacttggtggccacatccaagtcacagggctcaggatcacctggagtgccctgggtccaaactcaccctcaagaactgactcaccaggtaggtgagtatctgacagtcatatttacagaagctctccaggtgttctgaagcagttaatcccaagatatgatgatggaggtgtggaccatgtctgtctctacatcaccatcattgaagccacggcttctgacagtgcctgatatattgctggtgcccaataaggagctgctcctttatctactggttctttcaaaaaatatttactgagcacctcagcatgccagacttctggtgaatgacaaaatgaaccaatcatgcatcatgacgatgatacagctttcattaataagactttttgagttatctgatacctgaagcaactacaggaacccaatccacacctgtccctctgtcccctgctgggtagattagggaagacaaacaaagatttgggagcttttgtcacattctttaggtgcttccgggatgccaccagtgggttccaactgctcagctatgtttagaggtcacaggcaaacagagtgggcccattgcagactgcgaggcagggtgcctctgttcaatataaggatatagtccatgagacagaaggttattacaatgaggttgcctgggttttcctccccagttttattctgtacgccttttaggtaaattccttaatatctttcttcaaaatagttggatggcatttgtcttacctttaagggattcggctaaaatccacttgagtgctggcgcctaggcagggaacaggcagcaattcctacaggtccatctacctgatgacatgaagactagtttatggttaacaaactgtttttcactctctttagaagagaaatctctgtcaaaggtcacataaactttaccgtagtcagcaaagccccttcttataggatcctccctctatatttccaccctcatctagcactgtcttccttgcttgccatgccctagtcctgctgtatcaatagagtagagccaccagccacatgcggctcctgagcacctgaattgtggctagcccaaactgagatgtaccagaagtgtaaaatacaacccagatttcaaacacttagtacaagggaaacagaaggtgaaagaatcctattcataattttctacacagcttatatgttgaaatcatactattttagatatatcgagttttaacaacatattattaatttcttttactttttatggtgactaccggaaaaactaaaattacacaagtggcttgcatcatatttctaccgggcactgcaaccgtgtctgtattggcctcttgatttctgtactataacaagcatttcccccacttctgaggctgtgtgtttttttgtcttcacatgaatgactctctttccatgtctggcatgcctgactgctgttcacccttctaaatgcagcttgtatagcatctctggaataagacttgttgaatgtctatctgtttatgacctgcagcaaagttagccaaaatgctcaaaagggggacagaattgtctgcccagacttaaggctggggctccccgaagctgactttccagtgataataaaatgtccccacccaaatctcatcttgaattgtagctcccataattcccgtatgttatgagatggacccggtgagaggtaattgacccatgggggcagttctttcccatgctgttctcatgatagtgaataagtctaatgagatctgatggttttataaagcggagttcccctctacacaagccctcttgcctgccaccatgtaagacgttcctttgcttctcttttgccttccaccatgattatgaggcttcctcagccacgtggaactgtgagtccgttaaacctcttccctttatgatttaccaagtctcaggtttgtctttactaacagagtgagaacagactaatacaggtaataaagacttgaaggacatgaggtaggaaggaaagacaaaggtagaggaggagaaaccaagagtgttaccaagccttagcctgatgacaacaggcagttgcttgaagagagacaaacactcttgctttaagaggaataaatcaaagtggcttcggatacattaaccctagcttgtcatttgagaagacagccctttatatttagaatggctaggaaagactccttctagatgatttggtgctaatgttaagaacatcacgcaaggtgtccagttcgatggctgtcaacaccttctctaaaccttgtggcccataccatatcaacaacaaaataaagaaaccaaccaagtcaacaacaacaaaacatcgtcaacaacaacaaaacatcaccaacaacaataaaaattagaatatttaagagcctgtgcatgcttacttatgtgctgggcactgttttacacattccatatattaacttagtctttccaattaagtcttcaaggtagccaccgttattgttcccattctatagatggagactgaaacctaaaaaagtcaaggacttgcccagcatcactgagctggtaagtggacgatcaaagatttaaacataggcagtgtggatcccaagcctgtgctcttaacccttgcagcatataccactctacatcttctgtactattctctattgacagtatctatgaagctagcgcttcatggtatcaggatatgatactttcttaattattcattattttgtctatgtatgccttcttttcccagctacagcattcactgtttgaagggagagattcaaccatctccttctctggaccccacacccaacttatcctgttataggctcatggtcaacagatgactgcactgtgttactaaatgccagggaatacacagaagttgtgactgcttacatattcatggaagaaaaccccaactcctatcatccaagtttgaaactaggtcttctttcctattgggggaaatttctgcaggtgtgagtaattagaaaattaaacattaattaacaattcaagtgactgattgtgttagcaagttgcttgctaaccatacaggtaaatattgtgcccccatatgatgtttaaaaataaggtcccttgagcatattaagtagtagagatggttgactcaagattcaagagtttcctgacccctttaatatgtcacattttaagtctgtatataacaaaactattgggaaaggggattgccttactcactcaccttgccttatcatcttacaaaatatcttatattaaaagagagaaaaggatgacagctctgtatctatcacctattactcattatcctgggacaacaaacagccccagaatctttctttaatgaatataggctctcatagtacatgcttatgttcgtctcacgtttgctctctctcatttcaaaaccctatttctcttctgccctttatgtcttcaaaagagacgctgatattaattaccttgcttctctaacccctcatcgttttcagccccaaacaatcagcttcctgcttttaatcttctaccaaatctattttctcatgatctaccgaagtcaccctactaagtaagtgtttctggaaaggtattttcagtgcccatttcccttgaccaacctgtggcccttgactcactggaaaaaatcactccactcctgccctttgtaatattattctcagctggaattctagcctctgtcctgcaacctccagcttgattttacaatataaacactgctacttcctaacaagttcaccagatatacgaaataaccctgtatttcccactgaagtaaattagattgttgttcagtaaatattcactctctctttacttcttattcctgagaggagtatactgtcacattcctttgatatcagacttgatttggcttaagacatgtgaatggagcaggggcttaaaatgtcatgtgcattcctgtctttcactatgagaagcagatgtcttagttttttgctgggtcttggagggtgacagacacatggacttaactcacaccctatagtcaaaacaagccaagctggcccacagacacaagaatcagagtaaatgactcttatttcaatccaccaagtactggggacagtttggtacacatgagttttatgaaacagttaactgatgcacccatacaaatgttaaacctttgttcactggaacaaaggttggaagttttctccaacctttgttggatggaaattttctcttgttcctctacttctatggtattacctctcccatgccacttctctaacttcatgtcctgtattctctcccttattatgttttaaactcctttgaagagcaaagcatcaaaagttcttatccctagacagacacaaattaaaatttgcttattcattcattcattcattcattcagcaaatgtgtggattttagaaatgagtttctgtctcaaaggtatttaatacaacacctggctcagcttcatggactagagacacattatcactgaggtcacgttgttactgtttttgctactcctgctaactgttccaaaggggaaaaaaaaacaacatgcactttaaaagcatgatgttcttgttggcagaaattacaatagtttcttctcttggtgtttactcccccaacactttcctcagctctttatttctgatattcaattaccctttttctgcctggcttttctcactttcccagaagacttaccctgggaaactttactgttttcactggtgtacatttgcactagttggtttaattaccaagtgaatctacagcctctcagaacatttgacacgtctccctttcactggatccaagacatgaagcaatgaaaacgaatgggtgaatgttacagcaaactcaaccaaaatttattttgcctggattcaaggattaggctaacatgctagccagtttctgcccccctaaaatgtcaccctctggaatgacaaaaaccttaataagatttggaaccaaagttcctatgaccagaaactgctcaacatatatgcgtcacacacaggaaataaaggcacattttaaactagagctgctgggtcatctttaaaatagcagactgcctgtcaggagaaccaatggaataatcaatcactcaatttaaagtggggagctcctttaaaatgctagggtgatggggtatgggcacaaagtgaatagctgtgacagtacagttcctcagccaagatccacgaatgtaagcaccagtgggaagagcactagaccaagaggctcaaaaatatactgtgaccttcaactagtcacttaacaagtgctcattgtatcatttaaaaaataatacaatagaactccatgaatccaattaaatttaattccatattattcgagtgtttgtttaaaatgatatttctcaaagcaatggtcaaatgagtttggaaatcagtagattaaagaaggttaagcaggtttctgttccatgcaacttctcagtaactttaatagtctactgtgcaccgtgaagctctcagacctggtggatgtggtatggaacattccccagactaataggaatcaaagatcctgtttgtttaccatggacagccttgtagaactcctattctctataatacatggccatcaattatagaagacacagagatactaaagagaatagttttcttgggtcctggtcctgaggcctggcattctcatgaagctgagtttatgccctcccctgtgatttatgccatacctctgaatccttataatgatgtccctttttgatcttaagatggctttaactggtaactatcatttgtaagcaaaagtaccttattaaacaagaaaaacagctacgtgtgagttctgagtaaatattgctaatttatgtctatctgcaattgttacttgggctgaaacaaaagttccaggtaagtatgatagtcattttgccagaggagcctcaataatccctgagctgaaatactttcatacatcaagacgtaatcatctaatattaggaaagccattaagaaatacaattactactggaaatgaagaccttttacaggagaacagacatgatggttttccttaaaagctcttcccttttccacatccactttcttctactttaaaatgaaagtgacttcattttcaagtgaccttttataaagtccaaacatcaagtgtcgtaaatattctaagtattcagaatgaggtccagtactgtaatattaagttggatatgccagaaactcagaaaagcctatttctctttaaatagccaacttataaaattattcatattgtcttcctggattcccattatgttcctcgtgcaagaaagtgaaagtgttttatacaagccacactgtggggtaatatggccaaactaagagctttcagaaggattcttctcttattctctacttctgcttctgctgctgctgctttttttaaacaaatgagatcagaggcatactgtgattagcaatgcatgtttatgtagtgagacaccagattagaaatgattattatcatgtcacctaacagagtgataataatggtactctgagatggtacagctcagctgttgaggattcctactacaataattattttaaaattaattttgaagagaaaaaggaaagaaagaaagatgattgaaaccattaaagcaatcctgataaataagaaaaaaaaacccaaacactatgttttattcctaaggcaagcacaaaaaataaaataatcaccaaagtgagacacgactgactgaaaggtaaaaggaacattcattttccccatccaaggaaaacaataactgaaaacaatttaaggcaaaaagttaagcttctattctgagcaaaggagagttggactgtatttatgtgctaataatctatttataagaaataactgattaaataagatagataaaacttagtagacagaaatatatttttttcatagcaaacaaagcaatcaaaagagaagtgttgctgaaaatattgacaattaaaaatcattcaaggactctgaagtatatttcaggcagaaagagagcagcctaaggaggacttattacaggattgaaagcatcaccgtgaattcataatttttaatatataaactgagagatatggaaatatatatatagtatgtgtataagtacacatgcatataaatacacacgcatgtattgcctacctctactcacagagaggctgaagcaatgataccccactataaattagcatacctgatgtccagatcttggtttctaaataccattctccaaaaaataaaaataaaaaaggaaccagacctccttggagaagtggttggctccattaatgggacaggacaggaacaagatgagattagaatatcctgtggtgccacaaagttacaaatggctaaaaaaaaacaaagaaaaaccaaaattgtggggacaggtcaaaagaacacatgaaccagaatgaagggattcccctggctaaatagggacataaaataaaataaaaactgataatatcccagagactacagaattaaaaaaaatctacgattttacttcacacacacacacacacacacacacacacacacacacacacacatatatagaggggggggggaggatacaaagtaacatgtaggatgaacaagtctagagatctaatatacaatatgatgactacagtcaataaaattgaattagagttttttgttaaataagtagattttagctgctctcttcacaaaaaaagtaactctgagataacagacgttgatttgctttatgtagtaaccatcttattgtatatatgtatcccatatcatactttaaacctcaaatacacaaaataaaatttatttttaaaaaaatgggaggtgggggagaaaagcccttccttacagaatttcaagtcataaataaggagtaattaaattagaaagttaccatttaacaatcatcacaaaagtaactgtttcaggtaagaatcagtagtagtgaatgcaaaaaaagaatgggtaaaagtataagaaaaaacatactacattttctacaagtatattcctataagatacttattgattacaaaaggaaaaatagcaattttccaatggagaaacctggtagacaccacaccaaccaagtgatcaaagttaataccaagaatgggagaaaggagcatcagtgtctcctgatataatgcactaagaaggatataatactacctctgtaggattctggccaatatgcaaaatctgattctaaccatgaagaaatgccacatcagacaaactcaaattaagaaacattctgaaaagcaataggctgtgcttttcaaaaatgtcaaggtcatgaaagacaaagtctggggaattgtttgagattaaagaacactaaaagacaggacaactaaacacaatgtgtgatcctggaatggatcctggacccaaataaaagacaatggcagcatttccataaggtctgcagaccagaaatagctttatatcaaggttaatttcctggttcagtaattacactatgtttttctaagaaaatgtcttgtttaaatacactaaaggagcaaagaggcatcatgtaacttgctttcaaatatttcactaaaaattatatatacatttatacacatataacatatatggtacacacactcatatataggtgagagagagaaaatataatggaagtaagtaaagtattaatatctggggatctgagggaggagggtagagggattctttacattatgcttgcaactttttttttttgcaactctaaaattatttcagaattaaaagttaaaaaagaaaagagagggagcttgacttaatattgcagctgtaccataaagtgttcttgaacaagtgacttgtcttcattgaggctcggctccccctttgcaaaatagagacaacatgacttcacagggtgatcggggtggacaaacaagatggtgctgcaaagctccaacccaagagctggcccctgaagcacacagtaagtatagcttgtttttggtaaatccaaaatacaacaacccattagagggcgttactgtctgaaagcagtttgggggcacccgaggtgatgtgcaggccgcagagacaatgctgttctaggtcaggagcagaaacacaggctcctcacacatgcttttaaatggggctttttactttctaaaatgtgtttctacacaattgaaaacaacattactttttccagagtgggaggatgaaagcaatcgtgggtgggggcttcttgagaagaggggttattttttttacttttaaaaaggtctcagaacagttaaaaatagtttttccttaagcagcctccctctgctccctgctcccaccagctgctccttctctcagcctgcccttctctttgtcccttcaccattttcccctctctcctttttgcttccagtcactcatatgccacccactcctgagaaccctaccttctcttatttttttgtttggctttgttttgaaaaaaatattaatcccaaatgaacaaagaagatacgtgggaaggaaataaatggtgagctcttccttacttcaccacctgtcaagttttaagtttttcctccaactcacactaacctcctgcgcaaccataaacttcagtgcttgccaaagcccagaaaattctaagtaaaaagcagaaaatgaatgcagggaagggggtgcattcttattgttcatcagatctgaaaaaaataatgcccagaatgtcaaatgatattacactattaaaaaggtacagtaaagatgtgctaatgatagattttttttctactccaatatgttgtaaatattataaactatcatttactgtcattactttaatgatgtagaatgttgaaaactcaatctgggttaatttacaaataagtaattttgaaaggagaaaaaaatatcttttctatttccgtgtaatgtcccattacttgacagtcaaaatgtggatacagccaaaagaaaaataatgaaggtcaaggaggatcaaaatttacctgatagagtacctatctgttagaaatcactttcctgaaataccttctctgattttagaaaactgaaaaaacagaaaatacactacctttgacaatgcttgcgattcagggttgtgcttgtgtatgggggtgggagaacctctgctaggataggagaaagctgccagacacaagttcagatttaatagaaatagctttcaaatcaggagtctagccatcaaccagttttagatggacagtcccagtttcaagtaaataaaatatttgcatattagagcctcgtagccctacttagctgcaagtaaattttctgagatttactctgccttgcttcatttcatccaggcactgattattttttcattctttattcaccaaacatttactaagcacttctttatacaataaattctgagcaaggtactaagacatgaagaataaaacaggtctggctggagactgcacgaaattgccagtctgtctgagcctgtttgaattcataaagtccccgagaaagaagaaataggtgaggattagcaaccctgtaagagcatttacaaagaagggagtgcaaaagaagaaaatagcaccacagctcaggagggcaatggtattacttaccaagggtgcagtttgtttgatgacaaatctcaaaactgaatgcagtgattgtgttagatgcaaacacttggatgaaatagatgactgttcttgtgaccttgccaggaaagaggaggagtgaaagagagggctagagttctagtctcctttctgagttttgcattcattggcaaccatgtacctctagacatgggagtgcaggcatctatctctatcaaggtacatgacatgtaatgaaaggaagggatagagaccaggcaagagaaagcaaagagagagaaatagacagggagatggaatgaggtagacaaatcttagaggaatgcagtgcttctccaagtttggtgcaggaatgttcccattagaatcacctgagggggttatttaaaatgcagattcctgggctctgacccaggtctggtgagcctgaatgtctgtggctgggactctaagatttgcattttatatacgttttggggggtggttctgcatattaaaatttaagatcagaccactccctaaatccaagggtgctattttactgtttacttgaccaacagtataaatgggtgtcttcaaagccttgtcaccacaaccccatgcagcctgatccacttacttctctgtatcacactccctcctctcccaccaaggaaaacagagtgatcctgaagttccttaaaactcaactcaatctactgctcctcattagtaataaggttctgttcaaggaactattggctaatcattcatatcctgattgagataccagcatatcctacccaattattaactatggatggactccaaccaggaaatccaaaactatatgctgcttactgaatgacaataataaatgtaggctcttatttaattatgctgcggtttattaactatccgataataaggaaaacccctagtttattatagatctgtggggtgtgtgaatatgtgtgtgtgttttgagagatatatacaggaccctaatcagagagagtgccaggaataacagccatgcatgccaggcatcttttcctgtttctttttcagttacttgaatccacctgtgataaacttgccaaaagaaagaggaagtacaataaccacaaacgttaagtgatttttttttttgttctacaaactcgatgagttcactgcattgtctacttatctgtttttgtaatttcaacttttatttttgatttcggggtgcacatgtgggtttgttccataggtatattgcatgatgctcatgtttggggtatgattaataccatcacccaggtagtgagcatagtacccaatagctctttttcaatccttgaccccctccttccctcccactagtccccagtgtttatggctgccattttcatgtccatgtgtaccatgtttgtctgtttaactctcacttataagagagaacatgtagtatttggttttctgttcctgtgttaatttgcttaggataatgacctgcagctgcattcatggtgctgcaacagacatgatttcattctttttttatggccatgtagtattccactgtgtatgtgtaccgtatttcctttatctaatccaccattgatgggcacctaagttgatttcatgtctttgctattgtaaatagtgctacaataaacatacaggtagatgtatcagtttggtggaacagtttcttttcttttgaatatatatccagtaatggaattactgggttgaacagtagctctgttttaagttcactgaaaaacctcccaactgctttccacagaggctaaactaatttacattcccaccaacagtgtataagcatccccctttctccacggtttcaccagcatctgtgtctttttggctttttattaataactattctgaatggtgtgaaatggtctctcaccgtggtttggatttgtatttctctgatgattagtgaggttgagcattttttcatgtttgtttgctgcttgtatgtgttgttttgagaagtgtctgttcatgtattttgtccactttgtaatagggctgttttttgcttgttgaattgttgaagttccatatagattctgggtattagacctttgtcagatgcatagtttgcaaatattttctcccatcctgtaggttgtctgtttctctgttggtagtttcttttgctgtgctcaagctcttcgattaggccctacttgttaaattgtgtttatgttacattgcttttgaagactttgtcataaattatttcccaaggctgatgtccagaaagacatttcctaacttttcttctaggatttttatagtttaaggtcttacatttaaatatttagtcaattttgaggtaatttttgtatatggtgaaaggtaggggtccagtttctttcttgtgcatatagttagccagctatcccagcaataacaatagggtgtcctttttccattgcttaatttgttgactttgtcaagatcaggcagttggaggtgtgaggttttatttctgggttttttattctgttccattggtctttgtctgttttcacgccagtaccatgctgttttggttaatgtagccttatagtacagtttgaagtcagataacatgatacctctggctgtcttctttttgcttaggattgctttggctactcgggctcctttttggttccatgtgaatagtcttttctaattccgtgaaaaatgacattggtagtttgataggaataccactgaaaacctgtatattgctttgggcaacattgccatattaatgatactgattcttccaatccatgagcatactgtgcggtctttgatattgggtcctgactaggccaagaagacagagatagactggtccctcaaaccttttctctaatgtctggagagtacatattttatgcttttcagtatgtatggcctctattgcaacaactcaactctgccattacagcattaaagcagtcatatataatatataaacaaatgggtgtggctgtgttccagtgaaactttatttacaaaaacaaatagtgggccaaatttagcctgcaggctcttgtttgccaaccccagctcaaatcatcctcagacaaaatttagggagctgctaataataacaaggccatgctctgctatagtgctattaagctattgcctcagcatcaaattcaccctttggtattctcttctgtgataactggcacgtttatgtattgacaagaaagatgaccaccacatattaagtggggaaaaaatcacactttttatagcaatatcactttttttaacaaaatatgatcctctatacgtacatacataatgttgtataaggattcataagtctcagaaaggataatactgaaaggttcagaggggtaacctctggaaaatggaatcaggagtaggaagaaaagattactctgattttttgctttacattcttttgtagtctttgaatttatttagagtaagcaaatattaccattgtaagttacaacaataaaaaggaataaatcaaggtggagtcttaacagtgctgaaacacttttgttaatccatttccccagttccaacctaagctttacagaggtgctattgtcaagcaatcactcattcgttcactctacacatataataggcatccactttgggccagaccctacgctatgtgtgaggaattcatgaagtttaggatctaggtggaaaaacataattatataagctaaaattgtaattaaaacaaataatgtacatgaaggagagatggcatcacatttctttattaatatatttattgggtattatatcccattattgctggaggataaaatctatgccagggaatataaaaagatgagacagagaaaatgatacgagtaaacacgctgaggactttagactcagcatataggtgtttggttcctaccatatcatctacataatttccttaaaactgctgtgaatataaaatcacaacagctgttttaaagagactgaaattgaaattcaatgaaacaaggcatttgtaagtcttccttggctttctacattgatagtgacttttttttttctttttcacactcttagaatcagggatgggttagatgttatgatcttgctgttacttcaggcatcttctgttatcattctccctagaggccaaaggcagagaccatgtcttcttttctatatgttggaggcactgtcttttgagttatatgccaaacaccttctctggaattggtttgccacttctagggactggctccctgtcgccatgtttgtgtaatatgacaacagacttaggcaagtgatcctagctgggccagaattccttcctcacacactcaaaacaggaacaaaagagagtggtctagattttacaatgtattaactcaagggatgaagaattccttataaactagacagagacaaagatcttcagagataaaagacgggtacagacaagcagagagaagattaccaagagcagatcattctgtccaggtgcctctgattttttgaggtctaggttcttccaaaggccctactacatcctttgcttgggtttttttccatatgacatcattctacacttacattatatcttcccttttcactgaagcatctatatataaattaaagcatcactaactgatgcatgtgtatatattccaagatgtttaatattgctttcctgacagtagggatttttatctgcagtgcttcagagccaaagcaaattctaatgttatttttttcctccggaatgttctcccagaaagtttctaccagtttgctacaagttgaatgccacttgttgtcatttcagaacctcatatacagtattctttaatagccagaaacacaattataggggaggtcagaagatacatctccaaagtcttctaagtgttctctcctgtgccctacaggccaaaatggtttatatatcaaatgaccttggacaagttgtttatcttttgagtttcagttgtctcatttgtatacaggcaattctgttggctctacagtgctgctggcaggataagtgacaaactctttggaaagtccctcacacacagtcagtgtcatttaaggtggctcctcctgtgagattttgcaattagggatatgatcagtcttagtccattttttgtttttgtgaagaaatacctgaggtggtataatttataaagaaaagaggtttatttggctcatgattctgatggctggaaagttcaagattgggtatctgcatctggtgagggcctcaggcttcttcatcatctcatggcagaaggcaaatggaagccattgtatgcacaaatcacatggtgagagaggaagcaagagagagagtaaaagggtggggggatgccaggctctttttaacaaccatctcttctggaaactaatagagtgagaacttgcttaacccaaaggacaggcatcgatctattcatgaaggatctgccctcctgacccaaacacctcccccaggccccacctcccatcattggggatcaagtttcaacatgtggttttgagaagacaaacatccaaaccatagcattccactcctggattcccaaaacccatgtacttctcacatgtgaaatacaattgtttcatctcaatagtcccaaaagtcttaactcatttcaaaatcaactcaaaagtttaaagtccgaagtctcatctgtgacccaaggtaatttctttccagctatgagcctataggatcaaaaataagatgtttgttttcaacatacaatggtttcatgggcactgggtaaacagtcccattccaaaagggagaaattggccaaaagaaagagaaaacaggccctgtgcaagtctgaaacttagccgggcagacatgatatcttaaagctacaaaataatcttctttgcctccatgccctacatcctaggtactgcaaggggtgggctcctaatgcctcaggcagctctgcccctataacttcagtgggtgcagctcaagtagctgctttccttggttggagttgaatgcctgtggcttttccaggttgaggttacacactgctgctgctgctggtggctgtataatttgggagtccctttggtagctccacttccatagctccactaggaaccctgatagagattctgtggtggctgcacctctgtggaaggtctctgtctatgctttcagagatctatgagtcatctctaaaatcctctgaaatctatgagtcatcaagcctccaccacccttgcattctgggtgcctgcagacgtaacgtcatgcaaaaactgacaaggctcatggcttgcaccctccagagaaggagcctgagctatatctggggccatttgagccatggctggagccagagcagctgggatgcagggagcaacatccagaggcagcccagggcagcaatactttaggcctgtcacctgaaccattctgtccatctacacctctgggcctatgataggaggggtggttgtgaagatctttgaaatgccttaagggcctttttcccattggcttgactactagcacctggctccattttaatcatgctaatctctttagcaatttcactggactgggcaatagcattggattcctcttctgaaaatgtttcctttcccaccaaatggccaggctgcaaattttccaaacttttacactctgcttcgcttttaattataaattacacctttagatctttcctttgctgctttaattcagcataacctgttaaaagtagccatgccactaactgaggtctttgcagcctagcattttcatccaccagataccccaccctcatcacttttaagttcgaccttccacaaagccctaggacatggacacgatgcagccaagttatttgctactatgtaacaagggtgacagttcccagtaagtttttcattttcatctgagaccttgtcagcatggattttacagtctatatttctatcagcattttggtcacaaccacttagccattctctaagaagttcaacactttcccttgtctttttttcttcttctgagacctccaaactcttccgactgctgcccattacccccaaccactgggtactaattttctgtcttagttcattttgtatcgctacaaaggtgtcactgaggctgtgtaatttataaataaaaggatttatgtggatcacaattctaatggctaaaaaattcaagattgaatatctgcatctgctgagggcccctggctgcttacactcatggtggaagatgaaagggagcttatgagcttatgtatggagagatcacatgacagagaggaagcaagatgtcaacaaggtgctagtctcttttcaacaattagttcccttgggaattaacagatggagaactcatcccccaaaggcaggcattaatctattcatgacggatctgccttcatgatccgaacacctcccaccaggccccacctccaatactggggatcaaatttcaacatgtgccttgacagggacaaacaaatcaagcatgatccttagaaacaccacatggtagagtggaaagagtatttaaatgttagtcaggagacctctattctagttccctgttctcactaactagttgcacggccatgctgcttacttctttccaagaaacctgtaccttcatgcataaagtgctattccctatgcccgagtatcatcctacatcatcatgtcatggaaaccccaactctaattcatgattcatcttgagtcctgacttcttcagcaaggtctcctcagtttccacaatcagaggagaacattcctttttttgcataaataaacactgtacttggatctctcttatgggagttattaggctcaaccctactttatagatctagcactactcaattccttcttatttactttctaaagacaattcatcttccaaagttatagaaaaacaaagtttagcatttgctgcatatgtccaacaaacataattaattggataagaaacttggcaggtaattagtactaggcataccatttgcttttttatgcccagaacctagaaaagtgcctgacacatggtaggtactcaataaatatttattaaatgaaaaaatacccagacttggttaggaaagactatgtaaggcaacaatttcaagggtatatgcttttaggccaattcagtttgccaaaatctagcccttgatgttaaaaggaagctggggcttacagaaatggaggaccccaacgctaatggcaagggcagaaatcatcatttatgagacatagtctcttgtttggtggggaatgtttgacagctagctgcataattccacacggttccacaggagatgattttggatgtggagggaacactccaagcacacttcttatgaagacctataatcagaggtcttaacaaacacaagtgattaatatttgttgacttcatgacacatttattttctttagagcacttaccacagcttactctaactttattaaactttttagtatatttttgggttttttttgttgttggtggtatcctcaataaactatgagttctgtgggggaaggaaccatgattccctgtccattgttgtacatccactacacagcacagagtagatgaagctcaacaaatgttggatgaataaatatgcatatagtatgatggatggatggttgagtggataaatggacggaaagaggccagctagtcacccatacaagcttctgggttatgaacctaaataataacacaagttcaacagcaacaaaaataatcccattccattataggctggatgaaaggcttacccactgtcttacaccattagcgctgctctaacaaaatacctgacaatgggtgatttataaagaacagaaaattatttctcacagatctgggaaatccaagatcaaggtcctagcatcttgtttctgatgagggtagtcttctgcttccaaaatggtaacttgttggcagctccttcggaggaaacaagtgatcacctcccaatggcaacatctcgtaatattgttgaattggggattaagttttaacatgcaatttggaggagacacaaatattcaaaccatagaacccacttagagatgacagaataacgaatatatatgaattaaaatgaatggaacaacaacaataacaacagccatcacttatgtagtgcttactgtgttccaggcattgatctaaatgctttacatatatgaattcttaattcctaatacaaaaaagtgagtgttccttcttgatctggagccaagactgcatctatcaaaatgggaatctgatcatctctcccatctgccccccaccccacgtacatcaatggtctacatgacaatgctacaattaattccagaagtaaacttaacctctcactaagtgcccaaccaaagagactgcatggtttcccagtatgaaaatgtgaaggatcaattcacaatttgtttcctgcaaaactgtcattcctctcttcatacccatcactggagaaattacttttcagaccattctacagcttgggaatactaaataagccctaatgagttcaaaagtcggtaatgacagtactaattcagtggcctgtttggtagaaagtcagtctcccttcttcaaaagcaaaataggattatcaagtgagctgggagcattttctttacgtgattgatgggtagaaaaagtaatcacctttgaagtgccacaacatataatatatctcctgtgttctctttcttcttctgacacccacaagtaattgaagggaagggagcctcttagaatgaccaacgaagtgaaggtgacaaccctttctctgctatctaccactagagtgacatgctggggtcttgaatagttgagaactgacatgagtgtctttgatgggctgctttgatgcttggttcagagtgtacctgccaccagtcaggccacacagactttgggtgaaacatacatctaaggagacaagtgttactacttcttagaagcaaagggcctgtgcacctgtgaaagaagatctgttgtctgagctctggggtcggggtaaggtccgcaaggtggaagtgaaggaagtcaaggagcaaagcaagttgaagcaggtaagaaacactgaatatgatttcaaaacagtttctcatcatactcatccataatgaccgattaaccacaatgttcagactgacaactaggagatcattagcctcttgacctcagctcactgatgcagaagcagacagtcgtctccttggaaaaggcactgctctacagtagcttactttgtaaggggatttttgcaactacaagtaattcaactgaaacagagttgacactcaaaaaccttaagaagcagggattatcaggcaggtgaacagttttattcttaagagctcactctttctgaactctcctaaagcccatccaggcaaggacatatgagtttgttatctgaaggaagaaaaatgctttgaagaagatttataaagaggaagggtctttggtttattgacaagaaagtaaaagactttctagagttgtaagcgaaatgtcgctgttcaggttctagaacttgctggctagagaacagatggctgccacttgttggcacctggagtgacaaggagttgaggaaggaagagagtgtcatccatgtgatctggcacagaacattcttctctggagccactcttataaagaagagactggcatgtttggtgggtttactgtatgatatggtttgaatctgtgtccctgcccaaatttcacgtgggattgtaatccttaatgttggaagtggggcacggtgagaggtgatttgatcatgggggcggtttctcacgaatggtttcgcaccatccccttggtgctgttctcatgatagtaagttaccatgagatctggctgtttaaaagtgtgcggcacctcccaccttgcctttcttctcctgctcccaccacatgagatgcctcactccccctttccctttgccatgactggaagcttgctgagacctccctagaagccgaagctgctatgcttcctgtatggcatacagaactgtgagccaattaaacctcttttctttataaattacccagtctcagatatttctttacagcaatgtgagaacagacaaatacaccatagtacctccaacctgctaattaagtcaggagtctccccctggttggctgctacccacaggctccactactggtgagtcgtagaagacaaataaaggcattttaaggaatagtacgacaataatctctagatacatctgcaatcaagtaacagtaacccctctcagaagctatgccagtatgttgcagatactgaacacacatctgttaaatgaatgaaaatgaatgaaagaataaatgattatacagtgtacttgtttcataattgtaactggtttatattgatttggttatatctgcttggtaccatgtgagttttgattacataaagatctacagtctttgtatgacatggcctcagaacacaagtcaacttcttcatctggttctcaacctaagaaataatgatctgttgcaaggacaggctggccatggtagaagtacgaagcaacattttatctacatagtactttagaggtaatgtaagagattttcaaaatcatgcttttacaatgtctacattaaggtctggcttttaactaaaaagtatgtgaaacatgatagcatttctagattgattccattcagaggtgcttttatttcacacatatatctcagaccaagggtaagtatggtaagaacaagtcactaggaggccagcaagagaggattaatgaatggaagaaatggaaaggagagtgaaacactggtaaactcatcccagctccagcaagaggggccaagatatctgagctagctggaacagcacaataataaaaataataacaataatgacattcactgtgagcaaaagaactctgtaagcaaatcaaaaatatcagtgctaagggtcttaatagctgattataatgaacttcctcatgtaatctcagggagcagaaaagagaaaatagattgtgcatctgttcaaactaaacatatttcaagctggaaccagcttggtgccaaagacatctctgtcacagagaagaaaaaattccaaatggaagaaaaattccacttcatgctcaaacaccatgaacttcgacaggaaaattaggtaaccactgcctcacttacaaggcaacgcatcagtttcctatggctgcagtaacagattaacacaaacttagtggcttcaaaccacaccactttcttatcttgctcttctggaagttgggggtctgacacaggtctccaggtgtgggcagagctgacaccttgagcctgacgcaggtctaaaatcaagttgtgcgcagaggtgacttcctttccagaggcttcttttccagtttctagagtccaactacattccttggctcgtggcctcttccttcatctttaaagtcagcaataatgggacgaaaccatctcacatcacatcactctgacctgcttttctgcctcccacctccacttctaagaatccttgagattacactgagcccacctggacagtctaggataatcttcctattttaacatcagctattgagcaacctcaattccatctgcaaccttaattccccactgcatataaggtaacacagccacagtttctggggattacgacatggaggtctttggtaggaggggggtattctatccagggatccccaaccgccgtgccacacagcaggaggtgagtggcgggtgagcaagcattactgcctgaggttagcttcctatcagatcagcagcagcattcatttctcacaggagcaagaaccctactatgaactgcacatgcgaaggatttagaatgcgggctccttatgagaatttaatgcctaatgatatagggtggaacagtttcatcccgaaaccactccctccaccaccgggtctgtgggaaaattgtcttccatgaaacaaggtccctggtgtcctaaaggttggggactgctgttctatattgcctactacaggcatcaatgtttcaaatttacttaaaaatctgttcaggtccagctaccacaaatacaagtgagtgcctctcatttgtgaaaaactgtgtatgtgtaaggtgtgagaatcctatcttattttgctaggcagagctgactatatgtgctctcagagcccccagaattccagaaaaccaaaatttaaaaaaaaatattgaagattaaaaaacagagagacagtgttacccagtgaagtttctaagagaatctacccactaacagacttttccccatctcaagttctcaatcattcattttgttacatttttttatatttgacaaatgatatctaatgcatttcattgctgttagcagtttagacacttatgagaaattaaaaccccattaagtgtgaaggcatctaaacaataccagatctgccttccactgaatatattttgggatgacaggtctgcttcatctgactcctcaacaagaacagcttatgaaactcacagttttagtgacagggcccaaccggcacctatttttgtatcacctggaaaaaaaaaatgcccacataggcaatacatctgatacagaaatgaaattaaatagaacaatactgaggcatcaaccactcagatccatttcactgtttcctattctgagacaacctaattgaaggtggcattccaaggttaaatcctagctctgacagcatctcctgtcagacacctgtcaaaatgtaataagacacctgtgaaagggaagtgatgccaaagccacatcattttcccctacaccttgattcctaacttgcaggattcatgtcacccagcaaacagagtggtagctgggtgctgctggcactgtgccaccatttgcaggtgagggagggaagggaagggaacacaaggggtgggggagagagagagagagaagaagagagagagagaaggagagagggagagaaaaaaaaagacaacactgcaaaaggaagcacccaagcgttttaagtttagcaaatgattatgagcataaaaggacaactctgaacggacttgaattttaggattcatccctagagtcttgatcatgatcagaagcagggaattattttttaatatctgttttacataattaaggggtggtagctttcatgcaaatgaacgctttgaatgctcacaacaccaaatgggcttcattagcttagctgggcaattatgaagcaggaagtaaaaagctgagataaagacttatctcaaaaaggtctgaagcagggcgtgttgatagccaagaggcacaacgatgcattttgtacatttattacctcggaggcaaaacttctaggattctagatagctttgaaagcagtgcatacattccatttaacacccaaatgaaacaggtggaatgtttaaagatctgtagaaagtcttgaaatcgttcccacacattggaaggttttaccaaaccttctctatttattctaagtgctttttctattgtttttcaattgcttctctcatttccctcccgtgtacatttcagagaaaattggagagcttaaaatgcgactaaatataacccctgcactaagcaaacagtgaataaatccttaagaaattatttttgaagcatattctttctgatttgatttaaaaactgcaatatcacatgtgagtcttgctcaggagaaaggctatttgttcacaagacgaccaagcatgtagagggaaagctgagggtgaagggactgaatccggttctcagctatttcaatacagatgtttttctagataatcggcctcattgtaagttaaagaatcaaacataaatcagatctctcacaggctgagaaaaggcaaaacaacagcctgttcgttctgtaaaaggaccattctagttggcctatctggtacaaccaccttgtttaaaagacagtaaactgaatccagcaaaagtttattgacttggtccagaatattactgagccaccaccacagccaggcttacatcccagagctcctgtttcccatcctgggctgtgtatattcttccacgtcacctccccaggtggctggctttgagaagaagggaatcataaaaagaccagaaataacatatacaccttgaaggagttgacacaggattttttcttgatcactttgcaagccagggacctctggccagtgacaccctgcccaggcctcactcggccatgctacttgctataggagatggcccgcccacttagcccgctcaggccgagtctgacttgcacactagttcccaagttcttgtcctgcgccccagcagaatgaggatacactgacaatcaaagaaaaagtcagggagttttattgagtgatgaaaacagctttcagcagagtggggatgcaggggtggtccccctatctgaaggcaggaaagtccacccaatttgtctgagtctggggcttttataggctcagaataggggaggggcaggcagtaggtagtactcgaaaaagcaacattagattggttcaacggcattattcagaaagaatcaaccaagaaaggtcaggcaaacagaaacgcaagttctcactctgggtcgcaggtttcatccaggaccagcagtctggtctttcagccttcaggctgtttctgttggttcggaggtgggatttcactggggactcacctctatctgactaggtatttggctgcctcctactgtcctcagagtcatctgttcatcagtttgttttccctgtaccttcctttctcacaaacattccattggcagatttctgttttgttctgtgtgtttcctttccttctccccagttcaagctgaggcagacgcatggacaaagaaaaacaaactgctggctaaatacagagcagagagtgtcatggaatgtttacagaggaaatggttttaggaaccagagagtaggaaaagctcaggctggggaaggggcaggaggatgcaagagggaatgactttagggtataaaaggaatggaaacggccaggcacagtggcttgtgcctataatcctagcaccttgggagactggggcaggaggattccttcaggctaggagttcaaggccaacctggccaacacagtgagaccctatctctgttattattaaaaaaaaaaaaaaaaaggaatagaagaactcgagtccttaaagaattagggtctccatgtagagtaccaggtggccaggtgaaaacatacccaaatatcaagtaaggacacccattggccagcacccccaaattttagtccagttattacacccaacttggactggcaatttatcccctacaggtaactgaacatcttatggtctgggaaatctaccagcccctccaaacagaagatgaggagcttaaatggaatagtaggaagggggagctttaccccttgaccatgatgggtctaaataaaatgagctgggaatttccctaggagcccagggtagtgctacaaagaggacacactgcccctgaggtatactgtgttcatttgggagctatctagtcccagttttccaagacagactccagggaaaacaggtctaccttgaacaacatgagtttgaactgtgtgagcccacttacacatggattttctttcaccttcacaacctctgagacagcaacaccaacccctcctcttcctcctcctttacagcctacttaatgtgaagacgataaggatgaaaagtctttacaatgatccatttccacttaatagtaattataattcctctttctgattttctttttttaatcttttcttaattctaccaattaattttttcttttttttaaaattttattattattatactttaagttttagggtacatgtgcacaatgtgcaggtttgttacatatgtatacatgtgccatgttggtgtgctgcacccattaactcatcatttagcattaggtatatctcctaatgctatccctccccccgccccccaccccacaacaggccccggtgtgtgatgttccccttcctgtgtccatgtgttctcattgttcaattcccacctatgagtgagaacatgcagtgtttggtttttttgtccttgccatagtttgctgagaatgatggtttccagtttcatccatgtccctgcaaaggacatgaactgattattttttatggctgcatagtattccatggtgtatatgtgccacgttttcttaatccagtctatccttgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgacatggtatctcattgtggttttgatttgcatttctctgatggccagtgatgatgagcattttttcatgtgttttttggctgcataaatgtcttcttttgagaaatgtctgttcatatcctttgcccactttttgatggggttgtttgtttttttcttgtaaatttgtttgagttcattgcagattctggatattagccctttgtcagatgaatagattgcaaaaattttctcccattttgtaggttgcctgttcactctgatggtagtttcttttgctgtgcagaagctctttagttcttactaatattttcttttctctagcaaactttattgtaagaaaacagtatataatacatacaacatacaaaatgtgttaactgattgtgttatcagtaaggcttctggtaaacagtagtcaaattttgggagagtcaaaagttatatgtagacttttgactgcctgggagtcagcacccctaacccctgtgatgttcaagggtcagttgtattctgttagctcaccaatgtttacctgatcttacacttgtcctaacttctaatatggaaaggataggccaatgatatagtagagtgcttagatttgactgttgaccactggctctcaaagcctctccagtataactgcctctgcctcttcaccccatctcccactgtgcctaaaacccaacactccagccaaagagtaatcatgcgctgttgcctgaacataccccatacttgtctcctactagtctttgctcatgccagtcttcctacctcaaaggctctccctttgctctgtttacctcttgataacttatccatctaccaaccaagaatttttaacatctgaaatgattcacaaatggaatgggatgggctcaaacgataaaaataataatggctaatttggtgtcaggaactgtgctaagcatgtggaatacattattctcataattacctaagagggagctataataatcctcatttcatagatgaggcccaggagggtcaaagaacatttccaaggtcactcagctgggattctgacccaatcagtaggactttagagctgggctgttaacctgtaccctctatgcctctaatggtccttctaacactgtgaccctggcattttataatgtaactgtttctccccagatccctttctgaatgcccccaatgaggtgtaagccctccttactctggaagttatctcactggcctcacccgacatatttacatacttttttcatctcaccaaatacagatggtccctaacttcaatggttcatctcaaatttttttgactttttaatggtttactgggagtattaaatgcattttaactcatgataagtttattgggacacagctccatcatatgtcatagagcatgtatactgggtaagcttcatgaaagcggaaactctggctgatttacccacaatcagactgtctgagctgcagcagatattaaagtatttttcgtgaatgaacatctttcatgcttcacacagtagaagtgctccgtaaatggttgtggtgtgtgttgaattctgttcaaacaattatcaggaacaacagtcacagtttttcacagtagcacactggaaccccctttcttcactgtgagtgctgccctgaccctgacaatcaggtcaactggacagtctgttctcaccagtctcaatataggactgaaaagctatcttctccaaccaagttgtttggatcacctgaggtcaggagttcgagaccagcctgacccccgtcaatatggtaaaaccccgtctctactaaaaataaaaaattagccaggcatggtggtggacgcctgtagtcccagctactcgggaggctgagacaagagaatcgcttgaacccgggaggtggaggttgcactgagctgagattgtgccactgtactccatcctgggcaacagagcaagactctgcctcaaaaaaaaaaattgtgattttttgaaaccattaaattcttcactggtgtcatggtacaaacaaaatcacttgctttgactcttggccaagtccagaattgtgtcattttaaaaaactggtttttaaaaatcctaagttgtttccacctgcaggcataggcagaggagccttcgtccctcactacgctgaccccgagtggttccagtcccatcattccagaaacccctctctggtcttgtatcaaaaacaccacaaatcactgggattgctctgtcatggggtagaaggggctcgaggacaaagtttagcttaaaaccagagtgaatttatttctattacatatggttaaatcatgacttcttttctaatccctaaagctaaacagtagagtcatgctggagacacaccatcatctatgtcaatcagacaaaattaaaacagagaccaacatctccttgtttcatttaattttgttctcttgttactgcatgtgtgacaccaagaaccacttgacctttggacaaaaaagtagttatatataagccatgtatggctaaggtcctgttttcacaggccaggaacatgtaacagctctaattcttgttgactctatttctgaaatagagtctgaatatgtacacttctttctgtctcaaagtctaccccctaggccagaccaccattgcttcttacctggggaacagggcagtatctgctcttaactgacctgccggcccccgctccctattctaatcctttctgtatacagccgccagaagggcttgacacaaatgtaaagcagggaaccctgaccctgtgcttcaatgacttttcaatgcatggagaataaccaagcacattacctggcctgcaaggccctgcataatgtgatgtggcactgtacagatggccatgtccacctcgggccactctccctcacacctcctgcaccctgggctcactggcttcctctcacacctgagcacttgctgctcctttgacctggagctctcttctttcagctccccaggactggctcttgctcatccgttaagtttcagctaagtgtcaccttcagaaagtcctctctacctatgctttctacaaaggtctctgccttccctcacccaccccatgctattttctattacattacgtatttttttcttcctgctcctttttacacaaactgcaatgattgtctttacgtattgacttacttatcttcaattttccctattggaatgtaattccatgagggcacagcccttgtttatcttctttggcattgtaccccctattaacctgcaacacatcacatggatgtaaacagtatctgtgcaatgaataaattaacgaatgccaagttccatcacattccaaggtctgtcattacctgggcccctgccatcctttccagccttatcaaccagcgctctcccacatggacaattacgcaaggcacactgagccacttccttcaggaataggtcactttttcttgcctctgaaattttataccagctgttgcctctcgctaggatgtctttcttcccttcctcactcaagtctaattctgctcaaggatcagtttaattgttacttcctctaggatttcaaaagaatttttgaatgcaccaaggcaaagttaaatgtggcaacaatctgtcagaaaagctgccttttggtgggtgagtcccagaagtacagaaatcatggctaaatcgtacctttatcttcaatacaatacctggcacacaataggtgttcaataagtgttaggcaaatgagtgagtttaactaaattataacttcctgagaactaacaacatctcaatcactacgctcagtatagattgaggctgagggccgccaatgttggcagcagcaaagcctgcttaaatataataactacagctgcattgcacagaagtccagttagtgcagaagcataaagttttgagggtgtgtgaaaggaacaaagacaaagttcaggtgagacatggaagcaacgagaaatgcaacatggggcgagtaagccagcactttctgctttcacttctatcactttggaaacatttagtccagaatgatctgggggttcttacttatggttctaagacagcctccacattcctcagcatgtccagtcacaatcaccatctccccaagaaggcacaaagtaagcatctgtaaatccatagttggctattttggaaaattagtgttaaataagaataaaaaaaaaaaacccttcacctttatgtgtaataaagcactgcttaacaatcaaggtcacccatgtcaataacactccccaagcaaagcttcatatctttttaattcctaggctcataaagaccattgtcacttacatcattacaggattcaagggagaataacataaagagaatgtgcaggataattttcaaaataaaagagaaaaaaatgacacatctacatatcaaaccacacaagtcccgtgtctgataaaatcacaattatagatttggtgcatttaaccagtcatacatgccatgcatttgcgaaggtgccatatgggggagttgtggaaagtcaaataattcctagactttttctttctgagcacatgtgacaatgaatattatttacccctgtagtatagaaattatgaagcttaagaccccattgcttctttttaataaaagctaacacatcacagcttactgcttgacccagctccttggtctttgcacgttctcctctctgggcagctctctctcagttttaccccctaccacaggaaaggagacagctgtgtttctagacttgacagacttgtttttacttgataaacacattgtatattgtaggggagaaaacgatcacccctattcccctccttagttcttatgtgggctctttggcccgatctaggaaccaaattgacacaacacagattaacaaagaaaggcgtacacattttattaattttacacatacatgggaatcttcacaagacagtgaagttcaaagaagtgaccaaagcaacatgcttttacacgttttagacaaaaacaaacaaacaccacgataaatttgtgaagaaatgacaggataaaaagggatctggctagggaaaataatttctatgggagtgaccaggagctatatgaatgtaaaacaagtagaaggtaaggattatttcaggaagtttatttgctcagacacattgcagcacctaatcacagtctccactgataaggaatattctcttacccttgtacggagaaggcagccctcccaaaagaatctttatggcttgctacgtgtagaaaaagactggtcagttagccctctgcaattatactttttccaacgttttcagctcgaaataatcaacataccaattcgcatattctgggatggcatgtccttcactgcttcaggaatatgttttcctttgtgctttacttggatattaagttccaaccaattttaattacatgtcgcttgtgcataatattgccacttctaaaaagcagatcactttctgagttagaaagcttatctgctttccctccttatagacacttctgaagcagaaaggaagtaattcctatgctcctatcagatatgggctcatatttctgtttcaaatttaagtctgtgacccctacatgaggccaggattttgagaagagtgaggaaggtagactctttttaaaccatgccacaggcaaaaactcagaactcattttggggaggaaaaaaagtcctatcaaaccagtatactataaattaaacaatgtagcatcaaagataacttttcctttagttgttacccctgagtggtcacgtagccataagaaaatcacctccttgtcaacacatcatcaatcaaccagtgttcattaaataccaactctgtgctagaacctgcttggtataaagaattctattttgtgttcaatgtgtgcattcagtgctttgattgtaattatctttgaaatgacccaaatcattccaaacaactataagtgactttatattcagaatagcaaaaagctgacttgaacacacaatgtaaaagtcttgaagagagagtgaattaaacttttttttttttttacaacaatcagtgggcttatagaatagaaagagaaagagggggagaggtttttatcttttagaattgcaatgcagtgaatagtgatactagaagaacaatcaccaaaagattacagatgagaacttcagatgaaaataacaatgaaacaaagcaaaattcaattaatggccttagagaaggtgagatcagaaagagaaactgaaagttttttagacttctctttaagacagataaaatttagaatttttaaaaatccataataaaaaccagaacaatgctacctcgccaaagttgagttcaaatttagtcacttcagtcaccaagaatccaggaaacttagttactatgggaacagaggtcctcctcttcagaaaggagggcagtgtttctttcaaattccaccagctaaattcaagatcaatgatggttgtttaatatcctctcttgaagctcttactgtctttagtatactttaaaataaaataaaaactcaacaataatggagctcaattaagcataatttgtgtgcttcaacctttggctgggtgactgctctgtaccgttcacacttgtactgtagagcattgcaatttttaattaagatcactcattctatttcccctgaaccaaccaatgttgaggttattgtttggatacaaaactctccaggatacggcttcacttaacaaggactttgtttctttcaagtaccaggcactcactggttctgagtataggctgcctgccctactttaaaatgcatctcaactttatttcagagacagtaagatttcattgttactctacaggacttagaaataaatgcatgcatgtactcacacacaaaatctctcgataattttgcatataatacagtttttgtgctctatgccaacaaagaacagaatgtttagtaaatcacagagaaacacttttatttcttgagactgagatatgtgtggcttctctacttttctaggaattacatttaaaatgtaagaggacaagacctcattcaaccttttatgcctactttagtgatcagggtgaaacatataagaatattgcaacaccaaagctgtgtgtcactactcagctaatggtacctataaagaaacttctcttaattagctttaccctgaactaacttcctttgctctgccatgtataattaaatatgttagcaagacagaaatgtgagatgtagcagctttcacacccaaatttccgactccaaatttataaaaagtgtggatttttttttagttgaaagcccatcatgaagtattttacttttactctaaaaactttcaaaattacattaaaagaagaaaaagaaaatgggcaggaaaattagtaatgagagatgaattttcagagaaaagaattctacagtagtccctcctgatctgcagtttcccattcagtgctttcagttacccttggttaaccatggtccaaaaatattaaatggaaaatcccagaaataaacaattcataagttttcaactgcaagcagttctgagtagtgtgatgaaatctcattgtctctcactctgtctcttctggagcgggaatctttcctttgtccagcatattctggctgtatatgccactcacctgttagatacttagtagctatctctgttaccagatcaactgttgtggtatggcagtgcttatgtttaagtaactcttctcttacttaacgatagccccacagaagagtagtgatgctgtaaatttggatatgccaaggaaaagtcccaaagtatctcttttaagtgaaaagtcaaaagttcctgatttagtaaagagaagtcatatgctaagggtggcaacacctataggaagaataaatcttctatccatgaaactgggaaaaaaagaaaaattcatgctagttttgctctcacacctcaaaccgcaaaagtttcaaccacagttcatgataagtgcttaattaagatggaaaaggcattaaatctgtgaaaggaagacatgaacagaaatgtgttcgttcctactgatggcaattaggttcggtaccatctgtgatttcaggcacccactgggggtctttgattgtatcccctgtggataagggggtactgttgtatatcaaacaaaatctgaggtgcccagccaaggacagtgctgcttcccagaagagatgagactcccctatcctttctatcttcccaaagggtgcatgtagtgtacgcccattggtctctccctttcaggagtgaatccaaaagccacaatattgatggacggcaggaaacgtccagtatctgggctctgaagaaccttgaggatagaatccagctccaatcatacagttcctctgtatggataccttaaacaaaagtgtattttatcctttttaatttggcatcccttagaaatgtgaaacttccttgtgaaaactgctctttaaggaaacgaaacttttttattgtaagccttcccattgtctgtatataattaagaaaagatcagtgatagttcacggtggttttataataggtgaattaatcagttttaaaaagctgaattttacatgcatttgacaaccaatctgggcactattttcctaggaaaaggctcatttgattaaataaattttaacctttaaaagctttaattcttttttttttttttttttttttgtacacaaaggactcttttgtgatggttggatcaacttacacatccagagcacatgtgcatagataaaactttgcagtaaactatcctgttacagatagcttttcttacacataaaaatacattctgatgagcaatctaggggaaacaaaactaaaaaaaattaaaatacagatatacaattcatattctaatcttatcagaataacctactgttaaaacacaaactgaggcaggataaaattttaaagagtttatttgatcgaacaacaattcatgcattgggcagcttctaactggaagtcattcacgagctccacagagggaacatgatgggtggacttttataggaaggtcacaaaagtaaagcaagtcagtatgtgactggttatagctctataattgccttatttgctctatcccattagaaagtcactaaatatatatacataagtttgttggctacttccaactggacaggcttaagttctgttttcctttaatataggcatttgcaaggaatagcttaagtttcacttaagctttgcaagccaagcaaggtttaggtcacttatgaggtctgatatcatctgtttctttcaggcctagtctccattttaatttactttaacactatccataagaatattaaaaacaggcagcagatatgcagatattttatcaatacaaccttttataaatacaggaaagaatagtgttgacagtctaaatttgcttccttgaggcattatctgtttgaccagatttaatcatttaatttgaaacaaagaaacaaatactactctggggttgctgtgaaaggacattcagagtggacaaaacctctttaaacttttcttcaaggtttcatcttcacatatatgttagtttggttactttgacagattggtcaacttaatccaatacagttttatgggtccggaaagtgctttgcttgactttgaccgtatgtgtcatgtcagttaagttaaaagctaattcaatgtgtccacttcggggttatttccatcataaggcattatgtttttacttgggttgtatgggggagttcctctgaattgactagacagatgggaggtttagacacagtttaatattctgtacttgcagaagcaactattgagagctttgattacaactaaattcaagctagctcaaaagttggttctcagccatttaagtcaaaaggttaggtaatgtcactccctccaggggttcattgtccagtttttctgtgtattcattttgtttttatttcatgcctatctagtacccacccctgtgtcccacctatgcctgaattcttactgtgtaaactcttttggatgggaaatgaccagctcctgctactgaccacagccctccctcttgccagagcctgaaggacaggggactcctagctcgacagatcatgctaaaattataccttgtgcttagcatttcttggcctttaatcctgtcccagttacttctctttttttttttttttgagacagagtctcgcttttgtcgtccaggcaggagtccaatggcttgacctcagctcaccacaacctccacctcctgggttcaagtgattctcctacctcagcctccccagtagctgggatcacaggtgtgcgccaccaagcccagctaattttacatttgtagtagagacggggtttctccatgttggtcaggctggtctcgtactcccgacctcaagtgatctgcccacttcaacctcccaaagtgccaggattacaggcgtgagccaccatgcccagccattccttctcttttctaagatttgagttctcattgttaatctggtaattttctttttcacaccagataagcagagctggtttctgcattgctaactgggagcttcctaactaaaagagcctcacaaacagttaattctgctctagatgctgtaaaagagggggacgggggtaggggcagggagagagagagattacagtgataaaatgaaaatgctgtttcagccaggaagttttttctcccccatctcatatattaaaatgggcctgattttctaacttcagcataaaagcccagtaagaaatattagctcttcagttaatgtcattcacacaaggaatttatcagcagagtttgtgtttgaacttttcatgtcatctcacgcatctcagagggtattaaactccataaaacacaatcccaaaagtgaaatatttcccacttttactctataagtgagtcttagggaacggaaaaaaaaattccatgtctggcttattcctaaagagagagtaaatagagatatttcttgggccaaataatgagaagaatcacaacccttagggtttatgttccaaaggcctccaaatcccaacaggtccagcaaagcagaacagagaaaggggctgaatatacatgaagagaataacagaagcaagtggttaatggtttccttaaatgcggcagaaaatggcttatgtgtacctaagtatcctatagtactgagacttaccaagaagaaaaggtgaaaatggaacttgaggcccctggaagacatgttcttagctttgcctgctggctttctgcataaatctgacctttctgcaggtgaagttcttctttacagcccagtttctcctcttagttggctactgacccacagtagcagccaaaattaaaccaatgatgtatttctcgtacttccccaaatcacttttctttaaataagttaataataatccaaacttgcatttttcagctgagtgctttgatacttgcttctcaaaaaactacttggaaggtaaaggagttttcttttcgagacctcgatcagaaatactccatgattcacgcactcagttaggcctaaattagcccaatgttatggctataaaggaaacaggaaacctgtgttccagggacaatcttcttcatcactctattcccagcgtcctctcatatgaggacacggggggttgggctacctccatagaatgataataaaagtttgcctccaaaataatttggaatttttgggttaagcatcaggacatttcatatcatgtaatatactaacattcagtataaatctctaagcagggtaagtgggctcagaataagtcacaatctctcaactcatttcaccatcttgaaaatttcttccatggagcacaaagatgaactaagtaatcaccacattcctcgcaacatttatactttctgatcaggacaaaatgattctaaggagtgattaaagcagggtaagagagtcttctcaccctaatgaatccaaagatcaccaaatagacacccagtttatggcttagtgatgtaaaacaggtgtgattcagagccaagtttacgtaagttcaaattctgtttccatctttggtagctgtgcattcttggataagttacatcacctccgagcctcagtttcttaatctgtaaaacagacatactaacatgacttcatagaggtgtttgaaatagattatctaaaataagcaccaagtgttacatataatggttatttcagttattcattgatttaattcaattaccattaaggttgagacctggtcatcattacccagttaaggaaggggtttgacataaaaaccactcaagatttcttcccactttaggactttatgattgcctttaatttttcatgtttcaattatgtaactaaaatcttctattccatatatatcagaacacaccccatctaatctctgctaagtgtttctctactctgcctgtcccatgaaacaattcccaaagcctaggagagtctcctgtgatacagataccaaaatgacgtgggtcagaagtaactcatacatccatattgtcagaggtgaactatacaaaatactgagtacactacagagtgatctgataggccaagaagaaaaaaaagtaatctgatagaccgagaagaaaaaaaaagtatatgttgtttctctactaaagaatgtcaccgcatattgatttttctagtcttttacaaagactgtgttcagaatttagatcagtgttagagaaattcacttataaattcacatatacccgtatataaggatacagtcctgtatctaaggataaagtcctagcttaaatctggaatgagtaaaaacaaagtgtaaagttaaaaatgcccctctggtaagacaaacatatgcttttcacccaaaggtgcagttaaagaataacaacaaaagttggtagtgagatccctctaaaaccactgatatataatagactcctactgacaccctagaaaaatgatgccaacccatgcagattagtttcttccagcaatgtaattacccatttctttggggctatctttccttcaatggtgatttgagaaatacctttcatttatactccattttgcacaaataaactacatttaaagctctataattagctgtcctttgctactgtaaaattcagtgtttttgtccaaaaggaacagactattgatttacaaagaagctgaaatgctgtcaaactacccactgaagaagtaagaaaaaagtggtccctatcttggctctgcctctagactagctcttgtcctacctcagctttgtatccacataccgagccttctgttaaggtttagacttgcacagccaaggcctcccaggcatctccccattgacatctaagagacacctcaaattaaacatccaactctttgcctgaaacaccgttccttaagggctttccagattagcccttttttgcctctattatttgtatctcttaaatgcttactattgcaagatgtagaaaatcccaactaaaacgggcataaaccataagagaaattattgtctcacacactaagataagtggctcagtgaagctaagtatgggattatttctctttgctcatgaaagcatcaatgtgtcagttgggttcaagtacaagaatcagaacccattctagatattttaagcaggggagatttaatacagcaaagttggtgctggagaaataacttggagggctgaaagtacaactctaggtagagccttcagtaaggactcccagaacaatatcccattgacctcatggaacttgtaaggagccactcctcctgaagctgtcttggagccatagtaaaatcaagaacttgtcaccattacaactgactctactaatgcaagaaaccatagaatgcttatctgtagctgtggtcccgagtttcagaagcctgatcatagcgctgccactgctgcttctgccatcccaaccatttcgtaaaactcagaaagctggagagtgggcagaaaaacacgactgcagggaacctggacattgccacagctacgtttaccagcagaaacagccaaaggagggctgaaatatggcctccacatggctttcaccttccacacatcacatatacacatctaattggagaagactttttttgaagctggctaaaagagaatctgagaaatgatgcttttagttttgcaacaactttaacttgaatgaggatagaatggaaactacataaattcatctagagcatacgaaaataccagcttcctgggtgagtctttacataggagcatgatggaagcaagcagcaatcaaggctgccacagcctttgatatgttctaacagtagagaagaaaaaaatctctttcctggctatggcatagaaggccttcctttactccttatggaaccactttaagccatttgctgactcacagtcgaataccactgaccatggaatgctatgggctgattggctcagatggacaatctgttgagtgtcaaccacagtgtagtctatagtgtgcctgcttacataacatctaatcattgagggctttcctgaccatccaatctcaagtagcctcttctcctgacccatgaattctgtgtctgcttaccaataggtaagtcttcatggcacttaatgcactctgaaattatcttgccaatttacttatttgcctgctccttatctcctttccctactaagacgcaagctctgtgaaggtaaggatcctgtctttttcacgtctgtatccccaacacttacagcagcatgaaacacataccaagcattcaataaattgtttaatgcataaatgaataggctataatccatgtactacagaaaccttaccaataaaatgcttatgttcttcccagttaggccagcttagcagtttatttaaaaggggatgagaaagagagagctgttcaacgtgtgtgtggccatacacagtgaatctactaactggttagtcttttgggattcagtgttacatctactatgcgccagtcactgtaccctactattagcgatgcataaatcagaaatcttggcccaaaggaggactactggtacatgaagattaagattctacgatgacagctgcattggaaaacagtatcatgaaaagtgttttggagacgggtgcacaacaatgtgaatgtacttaacacttctcaactgtacacttaaacatgatcaatgataaattttatcattgggccgggcgcggtggctcacacctgttatcccagcactttgggaggccgaggcgagcggatcacgaggtgaggagatcgagaccatcctggttaacatggtgaaaccccgtctctactaaaaatacaaaaaaattagctgggcgtggtggcgggcgcctgtagtcccagctactggggtggctgaggcaggagaatggcgtgaacccgggaggcggagcttgcagtgagccgacatcgcgccacagcactccagcctgggcaatagaacaagaccccgtctccaaaaaaaaaaaaaaaaaaaaaaaaaaaaaaaaaaatatatatatatatatatatatatatatatatatataatgttatatgtatcttaccacaattaagaaacaaaaataaaaataaaaaatacattataaaacaagcacaaccttttatgtaaattacttacttaatcctcataatcagacaaggtaaacagtatgaatattcctattttaaaaattctgacccagtaaggttaattagcttgatcaagtttatatagctacttaggagcagggctgcgactagaatttaaaaatctccaactcctaagatcatgagcacacagatacacaaataagcaatagcatcatgttttcaaacagtctggtctcttccctggctctgtctgaatgacagactctcccattgtttcttgtaaacaggcaattaattgtacacactaatacacagaaatggcccttaaaataaggaagaacaagagaaatccttttttttttttttttttttttttgagacaaggtctcagtctgtttcccaggcctgagtgaaggtgcaatctcagctcactgcactcttcacctcctggactcaagtcatcctcccgcctcagcctcctgagcagctgggactacaggttcatgccaccaagtccagctaatttttgtattttttctaaagatgaggtgtcaccgtctttgccaggctggtctcaaattcttgggctcaagcaatgcacctgtctcagcctcatgggaaatcttgcactgatgggctaaacttattcaaaaagaaaaatcttccttaaaattaaaaatgaagagtaatagcaattgttggaagtgtactgattcaagggtatccaggtcaactgacagaagagagaggccagaaaggaatcatagtatactgaaaagccgctgtctgataaaagttggcaaggcagattctaggaagaaagagctcttcaacaaacaatggctaactatttaaggaaaatatgttacattgttttctcatctcatgtcaaatattaaaattaatcacatgcttattaataaaataagagcagaaaattgagccatattatacacagaagaaacttttatctggattaaaatagattttaagtataaagatcttaaaacaaaatgacaaaggaaaaaatgaaacataacgccccagaaaattaaaactttcagctccccaaagccattatcaataaaatgaagtgaaagaatagggagaatatgtattgaaaaaagtattaaagacgaagagctaacatcttcagacagagtgctattcaaatcaatatggtacaaatcctttattagaaaactaaatttaaagcatgagtagttcacagaataagaaatatatgtggttaactaccatatgataaaatactcaacttcactatattcaattaactacgattttaaataataaaacggtaattttgttggaaaaataggcagagtattttcatttatattcaagtcttcagaggccacaggtatatgtcactataagggaaaattggcctacatatcaaaatatttattcatagcgttctggcaacttatgccaatgtaatgatcagagacccacacaaagattagttgtaaaacatttgtcacagttttatgtataaccataacaaaactgtaaaaaactaaatgagagaacaaattctgatacacaaaggtgaatacttgaaagacattaagaaatcaggttttcaatacttcataaaatgaaaaagtattgacatagtaaagtataaaaaagtagaacacaaaatgtacaaacacgaataggtattatgtgcatgtataatacatatatattataaatctacaaagacctatccatatatgcatatatgcatttagataggaattttttaaagcactggaaggaaatttactcaaatgttaatgatggttatagatgagaagttgaattaatgttaactcttctctttatttctctccatttttcaaatattctttaataaattggaagtgtattagaaaacatccaatgatgtcatgaacactcattccctagacatattaaatctgttagcgttaactatagactagtgtactatgctaaggtgttatgacaaagaaaaagaagcagtagacagatacaaagacattcctgacattaggagaacttctggagaaagagacacatgttggtacaaaggctgtaatgtaagtaaagtagaaatataaacaaaaaaagcatgagaattatattgtagttgaaagccagaaaggcttcctggaaaaggtggtgtgtaacttttatatgaaaaagctggagccccatctcatggaacagtggcacaaagtattctcgatagcgggcatcaccatttgaactcgatcctcagccttcaataaaaatcataaagcccatcttcagagcccctcttttcttgcttctccataaattatgtactttcctcttttctcacctccttgagatactgtttacctaggaatgagacaattcattttttacagcccatcatgaacaattctgaaaaagaatcccctcattcattacaagacagtatgaattaaagctcaagaatgaactcttcctggcatttctaattaaatatgtagtctacctatcctctaatggtgaaataaaaagtagccccaatattaaagcaattccaaggatcaagcaagcaggtaaggcagattggccaagaaggaagagcaaggcactgagaaatcacaccatgacgcaaatgactttctctgttgatatgaaaattttttcctgccataggtgatgttgatattctaacaattttaaaacacaaaaaaattaaggggagtaacaaaatttcccttctattttttgagttatttaccgctaacaatctcccctctagaaaaagttacggaaatattgtacaaaatgcaccatgggttaaaaaaatgatttaaatacaggaaataattgttattaaatacatcttctagggagatccactctgtcccaatccttaaattagaaagtcagcaaaaagatgaactgaatccctgatgttaattgtacaggcttactggattagaactagagataattaattgctaaattttaatatgcattggactaaatggctgataagatttccagtagttggcttgaattccagaagggaatgattatttcttccccggcctgggagccctacaagccgaagacatttaaaatgtctgtatttggaatgaaagaagttgggtaaatagtagaataggttacagaatggcaaaaacttctagaaagaaaatatggaagttcaaattgccttttcccatttgaaatttagaatataatactgtatagaaaagaggatttaaatttttttatttttattacagcttcagtgattagcattcctgtactataatgtcaatattaaatccagacagacccaaagtctattacttcctatctaaaaaaaaaaaaaaaaaaaaaaaaagacactgtttatcacctaggtaattatattttttatgttcttaagaatttaggagcttgctatggttaattgggaaaaatgtgaattatggttaagtcgtgcctttttttattaaacttgtaacaaagcaaatgatgaagaaccaacaacttgccaatgctgagggtccagatgaacagacgcgcagagaatgcagatgagctgattccattaaaaagttggctgcaagggtagatgatgaaggttaagaagatgtaggactatagaggccaccagtgaaaaggaaaaaaaaatcccctgcttcctctgtacaaccttcaggatgttcaaggaggaagaaagaccaccaactgcagggtcagtacccagatgccttaggatatccatgaggctgtcaggcaccagtgaaaatcaggtctggttgtgcatcagaatcacctgtggagtttgttaaaagatgggattctgacctccattcttgcaaaatgctgatgatccaagcggtgagtttgagaccaaggatattatttatcttttaacaaacctcacagtaatcgtgaatgtacagcaaggtgttataatgtattttgatatcttattttttagagacagggtcttgttctgttgcccaggctggagtgcagtagtgcaataatgtctcaccgtagcctccagtttctgggttcaagcgatcctcctgcttcagcctcctgagtagctaagaccagaggtgcacaccaccatatccagctcatttttaattttttttttttttttgtagagacagggtcttttccaggatggtcttgaactcctggcctcaaggaatcctcctgcctaagcctcccaaagcgctgggattatacgtgtgagccactgcacccggccctgttttaattttttaaatttaacttttaaaattcaaatataggtagcgttttggtaatctcttattttaatctgaatgatggaatatgtcaaggggtgactgacagtagggaggcataatactgtcaggagcttcctacagtgctttcttcaattactttagaatctttggtctccccagaggtaaagtgactcgcccaaggtcacacagtgaattaacaaaaataagaaacgaatgctaatattagaaagtacatacctcctataattacttgcttgggcaataaactagaagttagtaaatattaagaacttcagggtccgggcctgtaatcccagcatgttgggaggctgaggtgggggcggcgggggggggggggtggtgaatcacctgaagtcaggagtttgagaccagcctgggcaacacggcaaaactccatctctactgataatacaaaaaaaaaatagctgggcgtggtggcgggcacctgtaatcccagctactagggaggctgaggcagaagaatcacttaaacgtgggaggcggaggttgcagtgagctgagatgctgccactgcactccagcctgggcaacagaggaaggctccatctcaaaaacaaaaacaaaaaaaacntcagggtcattaccctatttcttcaatttttaatttattttttatttttgagacagagtctcactctgtcatccaggctggagtgcaatggcacaatctcagctcactgcaatctctccctcccaggttcaagtgattctcctgcctcagcctctcaagtagctgggactacaggtacctgccaccatgcccagctaattttttattttttgtagagacagggtttcaccatgttggccaggctggtctcgaactcctgacctcaagcaatctgcctgccttggcctcccaaagtgctgggattacaggcataagccatcatgcccagcctatatttctttaattttaagatgcctattttatgtttttaacataaataaatgaagatgcatcttgtaattgatatgtttaatatggaagcactcattttttccaaaatatgaaatcagtggtgtacttacaactaacagcattataaaatccaggatatatgggaggggtattgcatatttattgtttctttgaaacaaggttttctatgaattaattttgtccctgtatgggtactgtcatcgtgtcgggtaaggaaatcaagactcacctgtgctagaaacctggaaataaactgttggcatatacttgcctcctatggtcagcatctaaccactcattgagtactggtgactcaatttctacctcttcaggcttttttcccttcccagttttaaaacttcaaccgtccctccagtgtagcactaatcaaatctaccacagagctgtcacatttatcctcattaaacacatacttgattccatgacttcctttttataaaactctactggctccccagtgctttcagaatcaagcccaaataccatcaaatggcatttagggtcctgtgaaatctgtccttaccctgcctttctggtatcacagtcatcagctgcttcttccctgcttaaaaaatcagcctaatcaacattcctgaagcttacggcactgttaccacatttctaatagtttaaactttcaaggcccagcttgaacatcacaccttccaccaaccttttccagtcctctcattaaaatcaatttctcccatctcagcattcccacaatatacagcacaatgagcatgtagtcttgcctgatgtatgcctgtctgtccacccaactggacagtaaactctctggcagcagaaactgggccttaatcatttcagtttcctccacagagatcagcacagtgcctgcacgtagtagttatttgctaagcatgaaatctttaacaaagccagaattgattctgaggcagggttaaagatattataaataaaacttcactgaactgaaattcatagtcccatgcagggcacctgcatatttttattaggtttcaccatggaaggcataattttaggtattattatgctgatgaagcacaatcttcctgctccaacttggccaaacccagggaagcaatttcctatttgattaagagtacgacagcagcgaggactggagtataaaaatttactgtagggttgagaatgtaagcttaattgtggatcaaatgggaaacattctaaacagcattttttaaaggaagtatttgaacagcctattttaaaatattcaatatcatcttcagcaataggcaagttttggaaactagcaagtttcaagacaggtactcactcattctctcttctgcaggatcctaaagatggtcctggggactatcagttacttaaatgtctcaggttattaattcttactttaattatatctcagctaagtgattttttttttccaccatttgctcacatagcagcgaacaactttacactgttatcagtcttcacatagcagttcccaaattttgcctttaggtttatatcatgtgcaatgagttttaaaaggctttctccacaaaatcataagagagccttaagagtttcattctctgcctgacctcctgaaaccctcaaaagataattaaagaatcatgaaatcttcttgtgatttcatttaaaaaactttttttaaatcattgatcatgtcttcattctactaaaccatttaagaagtgggcaatttaaactacccctataatggttcactagcctcagcaatcaaggctgtaagaagacagaagcctatgtccaacattattattagtagtaattatctgttacatattaatgctactaaagtaaaatgtgatctatatataatcgataatatgactataataatgtatataacaatccaatatagtttccccctttatctgctgtttcacttttcatggtttcagttacctgcagtcaactgcagtttgaaaatacatgtgtacaggccgggcacagtggctcatccctgtaatcccaacactttgggaggcagaggtgggtggatcatttgaggtcaggaatttgagaccagcttggccaacatggtgagatcccatctctaccaaacataaaaattagccaggcgtggtggtgcgtgccagtaatcccagctgcttaggaggctgaggcaggaaaatcccttgaaccaaggaggcggaggtggcagtgagctgagatcatgccattgcactccagcctgtgagacaaagcaagactctgtctcaaaaaacaaacaaacaaacaaaacaaacacacacacacacacacacacacacacacacacacattagccctgtgcctaatgtcacagtgccatcccttggtcccactccaacaactatgtatgaaataaacctgtgatcctatcagtcatatcccttctccaagcctccctttctgaaactctatgcctctaattctatgagacatttcacaatgttgtatctacagtcaactaagaaataatatatttgggtttatttcactctttgctcaaaccaaggataatttatcaggcctgctaagtataatctgctttcctaagtattgtgagaaatatgaaacagactacacttgcaaatcttaaattgtgatagaagaaatgagagaatgcacaaaagttttcttttcttcagaagagaaattgcaactaaaaaaaaacgcctagagataataaaagagacgttagaaagcaacacacaactgtcaactcaaatgtactgctaattactctagaaagaagtgttcagcattctaataaaaacattatattagtataatgtttgtcattaacaaagagttgcttacaaccacatcaacagataagatcctatgatacgtgttgtctggggcaaagcagggaattgtgggaaatgtaaaacaaatttgtgttgaatcccggccctcagggaacatttgagttcatgaaataaaactaggaatcagaaagactgggcaagatttgttttgctaggaattcaggatacatgaatccatgaggaaacatgaacgtcttggaactcgaacaggaggtggtggtaaaaatctaggagttaggtaaacagtgtctagccacaagaacagaggaggggtttaaacctctaagagatcattttatgggaaaaagcagcccctcctgaaaacattcaattcaggacacgaaggacagatagacactcagagcctcagagaaaaaagtatctggtgaaatctcttctagaaactttggctggggagagtttggaatgttgacttaaagacccacagtgaagtctagaaaaagatagaggcagcttgttacaatttacaccaacaggaaaccatttagaagggaagaataaatgttagttaaactttaaagattaaattacaaatttactcaagtgattttaacttttactgcacaagtagcaattttaagtcataagggatctgaaatgtttccagagttttaaaatggactgttttacacaagtgaaaaaaagattttggcttctagtgctgagcacagagcaatcctatgccttgtaatgggctggtataattgtgcagtttcattaaaataattttattactgacttcctagttttctgttaattatcatttcagagtaagaaaaactattacttttaaagcctatattaaagtaggcttaagcaagcacggaaaagaaagccagtgagagaaaatataaaaagaagctattaatattaacagttacagttggacacttgttcatttcataaatctttgcagtattagcaagattgatgagaagtagtacaaatgagaagcacatgagataagcgatcatttgttatcattactgaaatataaagtatgattcagtgtttcataatggatgttaaacttgatttaacatatggttggctcatttgctgaaaactatccttaaagacataaactcattctaaagtcaaagacattgtcttaataacagtctctgaattatctttctataagagactgagtaacctcaataaatacaaacttagggagaagttgtgaaaaggctgttccttaaggagaaaaaaagcaaatgtgttatatactctgattcattaaacatattatagagaattctaaaatatcgttgaaagagtaaagaattaatgtgttttaataccaacacagagtcttttgaattgattttcaaatgatgagtagagaaacccaatcactgctgtcagtgcttcagcagctacctaagaaatcctcctttgtcaacttcatttctctaatcatgagagaacgccagtgcccactttaagtttagtggattaagcagaccactgcaagtgctgctaaaataatttataatctatcattatacttcagtagtgatagtatactactgaatgagaatacactggattctcattcaacctggaatgagacacttaaaaatatttgttacatgagtatattcctatccacgacttagttttgtctgaattctcacttccattaacagaaatgcactaaaaatatatatatatatatatatatatatatatatatatatatatagagagagagagagagagagagagagagagagagagagagagagagacagagagagagagagatacaaagtctcactctgttgcccagactggagtgcagtggcatgatcatggctcattgtagctttgaactcctgggttcaagtgatcctcctgcctcaccctcctaaagcactgggattacaggcatgaaccactgcacctggcctacattttttttaaaacaacaatttatgtacctcctagagacaccagaccagtttgaagactagccgtcttcaacagtccctgtagcaattatgctcagaaaggcttatttcttgagctagcaagtatctgccctaaaaccaggttcattaataaaatgtctatctttcaaaaaaaaatacttgaatcttctgttttccctgatgtttgtgtctttcttcatccttggatacctattcttataacacagcccatgctcatctgaaataagtgacttcaagtcagctccattatcctgcatcctgcctgcaaaaatgatctagatatggggagtagtgcttccccttgttctatacactatatcaatataagttgttagactgcatcttctttaatcaaagtgtcatctaattcacatttagccatcagaagcatgtctaccaaagagcaatgcagccaaataagctttatgcacccatccttaggttatactccttagctaatgttactcttatttggcattgatttgatttattgacaacaaaaatacccatgtttgacaccaactagccttgatgtgccactattactgactctctcgactttgctcccccaatttgtaaaatgagaagtccaagctttcagtgattcatgaaagcagagtccactgtcagcctggccacacaactagcccctgaggatcttgctaggggtcaaaacccacatattagatctgatggggccctccaaattctctattttagtaagttcccaaatgcttctcacgcatgtctcttacagaatagatatagctgaaacaatctacaatattatatactgaactcattcaaccattagctcaaaggaaatgcatgctaaaccagctgcacaatccactctgtggagaaatccagcagccactccaagaagctgacctccaaaggtcatggagcaagatggagatgaagagccagccagggtctagagttcccactttgctctcttaccagctgtacaactttggacaagtctgttaacctctcagagattaggatatcttttctgtaaaatggtggtaataaagcctaccttagagggaaattgtgcaaattaatttttaaaatacacatgtaggccaggcgtagtggcttacgcctgtaattccagcactttgggaggctgaggcggtcggatcgcctgaggtcaggagtttgagaccagcctggccaacatggtgaaaccccatctctactaaaaatacagaaataagccaggtgtggtggtgcatgcctgtaatcccagctactcagcaggctgaggcaggagcatcacttgaacccgggaggcggaggttgcagtgagccaagatcatgccattgcgacagaacaagacactgtctcaaaaaaaaaaaaaagtgtatatatacatatgtgtgtatgtgtttgtgtatatatatgtgtgtgcgtgtgtacatatatatatgtacacacacacgtatgtatatgtaatgtacttacaaaatgggaggagtagagacactcgggaggactgcatttggctttattcattgttccttctggtatagcagctaacacacagtgagtacactaaaaaaacaatgctttgaagaaacaatctaatccaactacccatgacacgtgttattcattcagaacagtttattgagaggcctctttgtgtgaaacactgtgacagtccatttgctccttcaaatctcttcctccccttctttctctgttctgtgctgcagaaggctgatctatgtggactacactgacaggccccttggtgttctggcttctcctgcaagttggccagtgagggcttcataaggataccaaatgagaggaaaaacaagaacttggtctgatctagcagaaagatcagaccaaggccccaatcacagagatctcctgtttctcccaaagtactctgttttcccaaacatctctcctactgtgttgcagtaccactccctcaccttatccctttgggcttgagtctttaaaactccactgcttaccatccccaggttcctgtactaaccttgtggttcctctaaaccccaccagtgcctctctatatcgtccctttataaagaagttctctggagcgcagcctcagttgagtgtaccctctcttccagttggaagtctgatataaacaatgtgtttgaagttagggaatacagtaacaaacaaacaagtcatgatctctcatggaattctaactactaccactgtcataacaaacagctaccgtttattggacacatatcccatacaagctctatagaagttgtatacctgaggttgctatcatcatctctgtttttcaaatcaaaaaaccaaaccttggaaatataaaacccacatgagtatcaaccaacagaatttgattcacaacagaactcagattcaagccagagtcaacccaatccacagcacacgctcataaatgctgaagtattaccacatttacctcaacaatgtccctgccaaatggatcttcaatgtgagtcataagaaattttccccaatccttctccccatgccagatctggggattttcagaaagcctagtgtgaaaattcaggagacctgaaatgtgccctcttatcatatctactcaccaactggcttgtgagtttcctcctctttgagctaatacctgcagggaggtgcgcgcttccgtaactagtggcctttgttctaaccaccatctctgccatttttcctgtgaaatttcaagataaatgcaggcaagcaagggagagagcccttggacactcttctctagtattctaggacttttcaggcctgcctggtgagatcaggtaccttatcactagcttctacttgtgcaatctcccaattacacaagcgatcccatctagatttacaagtggccatcctctctgacccacaggccagagaactcagcccacgcaatgtttttaaaatagaccccaacccaggggaggctgacaggcacacagctgcaccaactttattaatgagtacccagacctttagataattgatttccactttgatcccagcctacgcatttctatctctgatatctaaatagcaaatcatgttatcttacaattaagtgataatcttcatggcagaaaagttgacaggtctataaatggcttctgcaagtgattaaaataacttcctccccctttccacccagccctggaaatgttctacaacttcacaaggctattacttgttaataaactccccatgatatgaacctcattcatattcaacaagtttacatactaagttactctccagaaatgatatacatcttattttttatgcttaaataagaacattttatttattttttatatctatttttttggagaaagggtctcactctgtcaccctggctggagtgcagtagcatgatctaggcccactgtagcctccaccttccaggctcaaggatcctcccacctcagcctcctgagtagctagcactattggcgtgctcctccatgtcagctaatatatatatttgtatatatccatggcagccaatatgtatacatttgtagagatgaggccttactatgttgcccagtctggtctcaaactcctgggctcaagtgatcctccagctttggcctctccaagtgctgggattacagtcatgagccatctcatgcagcctgcaagtacattttattagccttagtaagttacacaaagtcagcaaaacctttgactttaatattcaagtaatattaagattgttaaattttgcatgtatatgcatggatatgaagtatatacaagtgcagagtaacttgaagatcagtgttgaaacaacattgagtatttaatatgaaatgagaataaatgactaaaagaagataagttttacttcaataagtgaattgaatattgaaccctgatatggtttggctgtgttcccactgaaatctcatcttgaattgtagttcccataatccccacatgtggtgggaaagacttagtgggaggtaactgaatcatggtggctgttccctcatgctattcttgtgatagtaagttctcacaagacctcatgttttaagggacttgacctttcacttggctctcattcttctccttcctgccatcacgtgaagaaggacatgtttgctttcccttctaccatgactataagtttcctgaggcctctccagccatgctgaactgtgagtcaattaaaactctttcctttataaattgtccagtctcggatatgtctattagcagcatgaaaatggactaatacaaacccttactatgcactgaattctggggcaagtacccaagatattacagcaaacaatacccaccaatctgcttctatggcagaactgggccacatgcccagaaggcaagtaagaattactctgcaaccaactgatcaccatagtaactgagcatcaggtagaaagagtgctgggattgattagcagagtctgtgatttggattggacatagaaatgatatagtccattccatgtatgctcaatgaacactgcacaggtgaacagataaggctgtgacctcctctgaggcaagctccctggttattccatctccatatacctcaagactcctaacacagttctttgcacataatagacattcattttgcaggacagataccaagatgaattgcttcagtttgtttttaacaacgtaattctatttccaatttagataattcattgatttcacacctttccttcctggttactctatacttaattttcccttttcttctttccttttttgtttgtttttttttttttttttgaaacagagtcttgctccattgcccagactggagtgcagtggcgcaatcttggctcactgcaacctccgcctcccgggttcaaacaattcttctgcctcagcctcccaagtagctgggactacaggtgagtgccaccacatccagctaatttttgtctttttagtagaggtggggtttcaccatgttggcagggatggtctttatctcctgaactcatgatccgacctctcaaagtgctgggattacaggcatgagccactgtgcctggcctcttctttctctttctaaaagcacatcaatttacatttctacatctgcttcctacaaagaatttcctctgaatgaattcaacaagtgtcctgtacatgtaaatatatgtatgaatcttttgtacctatccatgtcaaagggtttttgaagccaaactgaaaactttcctagactacatgttgatgttctgaatatccacatttcgaggctcttaacaaagctgtatcaaactccttttcttctgagtaatatattatgtacgtaaagtcctaggagatgccctaagtctactataagtgaatttactttttgttttctgctttgcttcattcatcctgctttgctttttttctcatcccaaatataaacatctgttttgttatcaagttaaagttaaggagatataaaaccctctcagattaatgtacagcccattattgaattctggatcttagtgatatccaatatattatcatgaattttatagaatatactgaacttttaattcttatctgatttatcttcttaatgatgcttagatttccattcaaaaatcctgtctcttctcaccctttccacactgtgtctgtttttgtgcccttttctagagttttacatttctctttaggattatctctctctttctctcgctcacctacatacacacaccacacactccatgtccaaattcacagtctaagcattttggtgatatgccattcctcttctacctttgttagaagttcctctttcccatggaatcaattctaccggaaaaaagtgaaaaggaaccttagagagcaatcattaaaggtgcaaagggaaaggtccccatgtctgggagtgtctctaaccagctgtgtgatacgtgccatgtaatatctggctttggttttctcatctctaaaactggagggtaaaacaagactatgtcttgaaacctttctaattctgaaatgttcactattatcagttaacatttattgtgcttttctgcatggcaggcctcaggctaacggctggctataactagcactatccatgctcacaacaactccataaggaaggtgccacggttatcctcattatgtcactgagaaaactgaggttctgagaggtaaagtcatttcacacctgatgggatatggatgtaagactggaactcagacggcatgactctcaggttacagattctgcatcacatgctcatatcaactgatctgtatttttatacaacttcaaaaatgaaaacactgggcatgtgacctataaataatgaaatcatatacaaaaataaagaaacaccccacattgttgaaaaattatttcctttccaaaaattacttgaaagggcatcagtaagccctggcatatttgttcaaaatacagtcttactgaataggggtgtgtgtgtgtgtgtgtgtttgtgtgtgtgtgtgtgtggtgtgtatatacacacatatatatgtgtgtatgtgtgtataggtgtgtacatacatacacatacatgtgtatacatgtatatagacacgtatacatgtatatacacacatacacatatatacacatatatgtatacatacatatatgtttatatatatacatatgtgacaataaaccagtagaaaggtatatatatacacatatatacacatatatacatatgtgtatatatacacatatatacatatgtgtatatatacacatatatacatacatacacatgtatgtatgtatacacatatatacacatatatacacacaaacccacagtcatcccttggattggtttcaagacccctgcatatacaaaaattagcagttgctcaattccctgatatgaatggtatagtatttgcatataaccttcccacctcctcccattaactttaaatcatctctagattacttataatacctaacacaatgtaatgctatatagttattctaacatattgtttttatttgcattatttttattgttgtattactttttatggtttttttcccaaatattcttgatccacagtggatgaaattcacacacgcagagcccatggatacagaggtccaactccatttttaaccaatactcatattcgcacagattcatataatctcacactttcaagtaacgtaagcactatatgatcccattatattatcagcttgtcaagaaaactgcctatgctctgtgtcctttataaaacaatgttcctacctaataagggcagctacagcctttccccccagttctccctgctataaggtggcacccacagatatgtctccttctcttttgcctaagaaggcccttttgatttctctttcaatcctgtccccaagcctgaactcatcagtatcccctactgctgccagtctaggagagactccaatcatcttcccctactgctgagacagcagccttctacctggtagcctctgccctcctcagtccattctccacactgcttgctttcctatctcttctcaaagccaatcacataggtcccttcctcacttaaaacccctttatgactcctcattgcatcagaaataaaatctgaactcccttccactgtttcagaggcccactctcaagctctccacatctataaagtgccaactagtctttgccagttgtcaaacagactgagcttagctttctctcaacccagaacctttacataccctggctccttgatttggagtgctctctctccatctgccttctacagtcggaccttcacatctttcaggctgagacagaaccctcctccagagagctttccatgtcccccttatttagtctgacccaagcccattattctctcttcactcttcatttgtttccttcataataattctgattgatcattgtgttatccatctccacgtgtgtgtgtgaactatattctctcactatcacacaagcctccggaggatggaaagcagctggccttgctgatagatacatcccatgcatttaactcagagcttggctcaggttagatggtcactagttatgtatttgttaaacgaatgaacatatgacctcagatctttttgccttaagagaaagaaaagtaaaccatttgaaaaggggggaaaaattataaggctagcaaaagttaatggtattggcaaacattactacaggcccttgatagatgttaaaagaatggagaaagccctttaacatatttaatatatcatccctagttggaagatacttttagaattgtgcctatgcccaaaagttaataaatgggtgaggatattctgtgtgactaagaggggctaatgaattgataagtatttctgtgagatttactggatggttgaaaaatctctgtacattttcccctgattgtctctacctttctgctggcttattgtcatgctgatttttatggatctacattcaacagctaaggtaaataaggtaaaatgccagagaataatccaccataatatagtagaaaacttttttaaaatcaaaattcctgttgctaaacccaccatctaacaccttttatcacatttgagtgatctttaaaagaacatcacacttaaattcgcttttgagttagattactgaagacaaatgacatactgaaatagcatctaaaagcgttaatatacaaacatctacccaatacagatttaaatatagcagtgactgtacacctaccgaaacatgaaagactaccaggagacagggatttaatgtggattgatactaaaaagctaatggaaatccggtggtctttatgattgagatggaacatctttcacggctcttaaaaccttaggctggacagtgaagacatgggctggtgctgatgaaggagggctataccccaagcctgggaatctggaaatctgatgtgttcggccagagaaactccaaagttctccgtgtttctgcctttctctacccccacaaacttcaattcttcccttgctaataaaatactggaaactgagtaataaaaggcaaatttcatttcaatcctttgggctcaaagccagctccctgccaaaacttctcctgcctggaggggtagagcagggaatgagttggggcaagcacagatgtcctgcttctactctagagggagagatctgcaaagggtatggctcagcatcttgtctaccagctaatgtgattcataaataaatcacacagggagaagtgtgggaggcccctgtggttcaattctttatctctttttctcttccccagtgtggaagattgtcctgagagtgtggggaccagggggcagagtcacctacatggtctgctgtacagcagctctggcagcttagcacaacccattcacatactgggcagagcccttccaatgttaacctctgccagagctcctcctgacttttttttttttaatcctaaaagaggaagcatttcaaatgacctaaatctaaaaatagagtacttcatgctcatgactattttaaatagcatctaaaataaagaattaaaaaaaaaaacatgtttccatttttgtgacagtttccccttcccttgaaaaaaagaaaatactgtagagcttgtcattcaatctaaaatcagacttcgtgccagctggaatcctaggtttatttattactgtgcacagttcttacattaactgtttgttaaagactgattttaccaccactgagacacaatgtaagtgaaggtctttccatgttttaccaaaaagagtgattcaagcatgacccgtccaggagaaatgatattaaagaaaagggacagaagtactactcagtcactgatccaactatatttctggagaaatcaagtttaaacataagtaattgcctaatggagttgggccaaggtggagataggaaaatatccatgacacttccagtatttgcaaaacaggttcaaaaataaaattgcaacattttatggtctgtaacatacttagtcacttagtcgcagagacatctggaaaaagataatccaatggggcaggtttttattctctactttagaaaattgttcacatttattccctatcatagtttcaagtagaatggttataattcatccaataagcttttttaaaaagcagggaatcacagtttctgggcgtggggcccacaggcctttacaaaacttcataggtttatacctacataggtcatagattgtgaatgacacacaacatgatgactatgttcatgaacacacatgctcatatacatatatacatgcagtcaagctcaacctagattcacaaatcttacaaggttttacttccacaataatgggctcctgttcagtctctcttgccagccaatcctccaagagagacaccgacaaatgtagacacgtaaacatgctcctccaaacatggaatagctatcacttatttcaagtcatcaaacgtatgagtcagctgtatcttgatacaattagttgaggttctctttcaatgtactccttagacactctgtggtgtcaagctgtggtactatggctctttcactagctcattaccacctccagcagagtctgccttggtatagcctcagaggcacagagcaagcactcaataaatatggagtagaggaaagagaaaggtggacaggaaaaaaggggggagggaggaaaggagatgaaaaaggatagaagagaaagggaagccagtgagggagtgaatatctagctgagaatggaggaggaatctcaaataaaaagggcaaagtcagaggacactcagaaaaacagaagtggatggacaacagtgccacaggaactcaaaggtgcaatgttttcaaaagatagatagattccaaagatggcacccactgatgaagcttttctattaccagggtcacatacaaacaaatcaattcggcacccagggctgaggtggtacagcgtcacgtccttaaaatgccttcagggaccaggcaaatagcataaatataagattataggcgagaaaatgcttaagtttcaagcacagcatctgtttcaagcagaaaaactgtgcagatcaaacagctcagcccagactctatccctacaccctggagctaacaaatcaatttgattcaaatatttgtggaatacctacaatggggttttaatcacaaaactttacttgaacagctgcaacctctagcctctccaggcttctttcctcatcatggggagaaaaacacaaacatttcaacatttgttgagaggagaagaggttctacatgaagtaacccgactgacttatttgtactgagaaaggaaaagcaactaaccctgacctaccagaacttctcacctcgggcagtggcagtgagcagaggtctcagcagcaggagcctgcacaaccccaaaggacatagcagagactccaataccatgtctgaagcaacttctttgaaatcaaaatgctgatcttctcacatgctgattacagacacttccattatcaaacagaagaatttggggcaaaatggattcttaatggtgtctgtttcctacattttcttatcagtagagtggctcaaaatctaaatccacctaaactgtccatcatcgccccctccccaccaacaatgctctcattttatcctgtatgtgtttttataaaacgtctcaccatctgtaacaatatatgtatttgagtaattgctggtttactgtccattgcctccactaaactgtaaactccatgaggtcaagtacagagtctagacttgctcatgactaaatcacctgcatctggcacatagtcagcatgggatatatatttatctgttggcccaacaaatatgactcttgctgctatctgattttacacaagcacacctccactggcacaacacaaggagaggagaagagggaggcatctggagagctcaatgtcaaggttacttcccagctgccattccttgtgtttcctgaatgcaagtgtaactagtaactgtactaacagagccaagggctatatattcttcttcatcccataaacagaaaaataaacagttctgtggaactgtgcaaacccaacttaaatttcagattccagacccattatctggcaccctttgctcagaaatactttactaccactagaagacaatctaacccctggtctcacataccacataatgctgaaattcttccccattctgtctcaaacctgcccacaactccgtttcatgagggctgagccactatccaatttctatccttataggggttcggttttagactatgctcacaaatcccaaattcccagtgagttcaggaatgatgcttccttaccttaccttacataggaccttgaagatttctattacccgcagatgtaacatgcagttgttaagaccgcacattgcatcagcccacgaaatgagttgggggctatccagcctggcccctctcacgaggccatgtaccttgtgggggagctgtgtctccacaaaaggagtatctttttctattttatacaaacatgccctatggattagtaacagtctgatactagaaaaaaggaagctcaaaacttcacaggacatggcaaataaaacccagtgacctgataagaggtacaatatctccttggtttaatatttcacctcttctaattagaataaaatattcactaggaaaaatttttatgatagtgtccttttggcattagcatgaatacctccaaggagccgtattattcaaacaattttctatttcaaaatacacaggtagtaagaactaacaaatcattacatttccaccaaatgcacggaaacaacaaacttaactaagaaaatactgaagcagcttttcccaacggtacctcgcctccctagagcggaatggttttcttttaaggaatccctattgatgccagaaccaccttggaagaataattaatgacattttgaaaactgaacttccttctcactgcctttcataatgcaaagtgaaggggaggcggggtgagagtcccccaggaacacacaatgcatttttacaagagcttctaaagcccctcagtgagacagaaacacactttctcatttaagcaaaactttagaaaactaacaattaaaatgtgagttaaactgaggaaacatcttacatctgtgattctccctccagaataatatgactaggtagctagctgccagacactcttgtttcagcaatcatgtgactatgtgatgagggctggcttcatgattcaggtggaactgatcagggcactgacactgatggagacaaagcttgtcaggcatgatgtccttgtaggcaacaatacctgaaactctgttaggaaatctgaggtctttggatagaaggaaggaaataagccaaaggctagagtcacacagtcagtatcacttcagacaagtcagcactggatcaacctcttcacctgtaaaatgagggtaagaatatccactcaataagtatatgataaaaagaaagtgacaacacaaagtgtaaatgaatatttaagcaacatctacacataagagaccctaaatgaatatccgttgaaataaaagcaatggttacatgcttctcatatcctgtggcccactgacctcattagtcattatcttgaccagctccacttgcacagcattatgaattacatgtgtgcagggctattcaattgtctagtttgatgttcttaaccttgtgaggcagtaaatatccattttaaagatgagaagactgaagtttacttcacaatcttagtggctccaatcgaagatcgtccactgtaaaattcagttatctgcctcatgatttcacggcttatggctctatggaagttctattcttaacatgacgcaaaggaagtcagaagttgcaaaactctgagttagataattaagccatgaaaagtgattgatgctaagcatctgtacacaacatgtgaaccaagggaatgagtgactagaacccaaagagagtttggagttatttggctgtgactgagaaatgatgggctaggaatccaggtaacaacaacaacaaaagtaaatacacattgtctctcctctttgagaagatgaaagaaaacatctttttcagttcaatgatgcttcctgtagacagaaattttctcattgaatggacaaaactagcaagtgcacaagttaataataaccttttacccaaggttccatagcaagttccacatgctatgctatcatctaggctccctgcctgcctcttctcattgcatcctcatgacaacctcataagttgtcatgctatctccaagttttggatagagactgagtctcagtagaggtaagtttgtttttcaggcagggttgagcttttcgaagtacagagagaactggggaatggggtgcttcaaagtcactgaaagagctgaagctgtgggctctagaaagacatccaggatgaccacgaggagtaccactacttctgccaccatcagaaaggcagagactcaggaagtcaccaacagaatcattattagaagtagactgtctgaattatgaacatggatcagaaagctgctgtcaccaacacagcctttgactttataggaaagccacactagcaacaaaataaacgctctatccactgcttctcagtggcccttcactgagtggccaggtactgaaagatgagtgcccaaaagcccgatgtctcctccaatgttctagccagcaaagatcacagagaatacagaaagttggcttcagtctcaattctgtcttccaaaactcaaacaagtgcatctaactggcaaacaaggaatcagatccagggccttagctgtaaagcatctggaaatgtaatgtttgaccttcccgcctttcagtacaggaaggcacgtgatgaggaggctagcaaggttcctgagagctcaatcactgtgtctacttcatcagatttgccatcccatagctgattcctaattaaagggagtgagaaccaaaaagggggcaaagccaagtatatgagtaaatgcacagaaacatgacagactaatttaaccagagaactaaaaagggtttagcacccactaagtgaagagtgcatttggaaacaaggtggaggatatagctggagaggcaagaaaaggccagatgatgaaaagtctatcaccccagcttagaagctttctcagcctaagctaggatatcccttctgaacttcttagaagccttgcacaatcctcagctactcattgatcacacagaattgtaaccattcatgttcttgcctgctttactgttccccctgactatgagggtgggaggtcaagggaaaggaggggctattccactttgtatttctagaacatagcacagtgcctggcccataaacgaaagctccagaaatacgtgttgtatggaattacgtcccgaggttccttccactatcaatcatctacttaaaaaggagaaaatgctctctttaccttaagtacctttcattattaaaaaaaaaaaatggttaactatggccacgcaatggctctcacctgtaatcttagcactttgggaggccaaggtgggtggatcatgaggtcaggagttcacgaccagcctggccaagatggtgaaaccctgtctctactaaaaatacaaaaattagccgggcatggtgacacatgcctataatcccagctactcaggaggctgaggcagagaattgcttaaacctgagagacagagtttgcagtgagcagagatcgtaccactgcacaacagcctgggcaacatagtgagattccatctcgaaaaaaaaaaaattggttaattgtagattacagattgataattgtaagaatatattcctatagacatatttttgtacatttatgtacagtagtagacaaatgttgtttctgttaactgaaccaccattctcccattctgatgatagtgcctcaattttcctgtaggaaaccacagctactcccctcacatgaagaaattcacatgaggggtatgacctcagccctggggtttcagtttggcacatgacatggctggatcaatgaaagttctccgtgggattcttgatatgagcaacttggcagtgagggggaaaaagttgctctcttatgctgagattgctactagtggcaagatagtaacattgtatggccaatgaccaccacatgagacaaggtgtccaaagaaggcaacatggaggaatcagagcccatggagggaaagacacagactctattttttttttttttttttttgagacagagtttcgctattgttgtccaggctgtagtgcaatggcgtgatctcagctcaccgcaacctccacctcccaggttcaagcaattctcctgcctcagcctcccaaatagctgggactacaggtatgcaccaccacgcccagctaattttgtatttttagtagatacagggtttctccatgttgatcaggctggtttcgaactcccaacctcagatgatccacctgcctcggccttccaaagtgctgggattacaggcgtgagccaatgcgcccagccgggagagacacagactcttaacaacactgagtactcggatctagggtgtcaaagctgtcatcggtcagtaaatttctttttctttttcttagaaggtctaggatggtttcagtctggtaacaccaaaagaaattcaaagttttaagtttaccatacataaactattagttgaagaaatggcaatgactaaatagcagaagaatgaaactcagctttgggggacatcaatctgtcagtcatctactgtgcagccatttcgaggggggataactggaagagatgaggctatcacctggacattcttaagagaattaaaacataataagccctctccctgtctaaatgcacagataattgattaacagaaaatgatcattactaaaatggcttcagagtttttcagggttgtgggaattacaattgttctgaaagaaaactgattacttacagtttcctcctaagattgtagttgtgcagtaatgatattgagacagcatgatgcccattaaaaaaaaaaaaaaaacactgaagactttacaaataactgagccaaatgagatattgaaaaatcaaagcgagaaagtcccatcactaaaagtatacaaatacatgagaatcagccagtaaaacaggaagtcactctcatctaaaatggcctttgcttgtcatcaaactcatatagaattcctaaaatctgtcagtgtagtagcttctaagtgatatgtcaacaaatatattcactgagaatacttattctgcctagagccaatgtttttagaaaaacatcctaaagagtcaactgttaaatcactaaaatgaatgttttgagcaggtgtttggaattgtgctgatttatccatattttccagtttaatttccacgtttaccaacaaacttcagcaagaaaacataaaatgtacctggaaggattatgttcatcataaatacaaggacagttgcgctaaacatatctgtactggtaacagtgattcataaaccatattcattaacctaaatccttaaagttttctgtttaaactgtagtgattggaacgccaagtgtcagagtttaaaatggtatttttaagctattagcagttgacattttaattaggcatatttatgacagacatggggggataaaaaagaaggtaagcaaggaataaaaggtgcatcaaggacacaagaaaagagaaaagaattaccatccattcctgttatccttttcttttagcatatcaataggaaagcagtataactaactggtcaagaatgtaagatctaaagccagcctttatcagctcaaatcatgactctgatatttaccagctgtgagaccctgaacaagttacataaactgcatctgtttccacagggataatgccagcacgtagctcataaggttgctgtgggaactgaattgggtactgctcaaaaaatatgttgcacagggcccaagaggaaagaagtattcaataaatgctaactactactatattatttgtaaccttacttaccgggtcaagggctaatagtggtagtaaattgttgcttaaaattttatttatatatttcttcttgaaccagaaaagatgccaggctatttattttttaattttttgttgttgttattgttttacaaagggtttctcagtctgttgtccaggctgcagtgcagcagcacgatcatggctcactatagcctcaaactcctgggttcacagagtgatcctcctgcctcagccacccaagtagctgggactataggtgcacaccactatgcccggctaacatttttgcgtttctttttttttttctttttttttttaagagatgggatttcactatgttgcccaggctggtctcaaactcctggcctcaaatgatcctcctagatcagccactcaagtcactaggatcacaggctcagccactgtgcccagcatgcaagacaatttaagaggcatacaaaagacaaaaatataactcaacttaagaacagattaagaattaacaagataagaatatttaagaataggttaagtaaacaaatgtcatagacaaaactagagtcaggaacaagacaaaggataagaatcacttagatatggctgctctaagcagctactagtttgtcttcagctttctggcatccaacacaagaaagaaaactgggtctgcggcacaattttcaatattcgtgagattaaaatatactaaatgcccagaaagagagagtacagtgattttgttagaggccgagaacataaggaactaaggccatgcagcaaatcttcagaggggcacatcatagccacggtagatagcattgccaaactcaatttcttagccctccttgtatccacacctgtatatggcctctggggccacacgtatttccccacctcttcagtcaaagcttggtcctaggacttccttaggccctgatatatggggagaagtgacagtgcatcttcactcagttctcaccctctgccttaaaaggtcttaagcatttctgcttgccttgctgcatctccactacagccatagaagtaagtgacatagttggtgtggttgctagtctaagggagatgaaaaacacaaagcagtatggagcagagccatccactgagcccagcctagatctgctaaaccccagatgattcactaagacacaagcaaaaataaatgattattgttttaaacttcagagttttgggataatttgttatgcagcaatggaaaacaaattcagtaacaaaatgatgacactttttaaagcagtatttctattgccaactataagtcaaacagtatgccttctaaatggcttaccataacctatcttcataactttgatttctaaacttattaaccttgttactgtaatttcagagaccctcaacaattaatataaattaaatttgtcactcaccctactaaatgaaagtactctggaatacagtcaccaaaattaaataaaggttgaggtcataggcctccaaatacaggccatacagcataagcaaaattaactgggaggtggggtagggaggcaagcagtaggtcataccttaaagagagaccaacggcttccaaagtaacaacactaggcatgaaagtagcccatgtgtggccctcaggagagctgccatgtgtatgaagacacactggactgagaaatcagtctcttcaaatgtgtgctttattcaaaagatatcagggcagatgtcccacaggatttgtgttgatttgagttgcttctcacatgagcaaagctatccagcatccatacggcagaagttgttatggggacttattcatttacacatggataatgaaactcatgagcaaggctggggagaccaactaacaactctaataacaacagtaatagctgaatcccattgatatggatggtgctagtcactgtgttaagcactaagcatcaattatttcattcaattcattgaacactcataataacccaaggaggtagttatttttattcatttctccaaccaactttgccttttgcttttacaggcaagtattctggagcttggagagactgagggacctggctatagttacaaaggcaccaccttgtttgacaggggctctcaggcaaaattagaacaggtaaacttgattagtatttgctttaggtaagtcttgaacattttctcagttaactgaagattttttttaatgtttatgtattttttaatgaatacattataattgtacataatatttacggggtacaatttgatgtttcaatacatatccgtgttgtgtaatgatccaatcagggtagttagtatatccatcacctcatgcacttatttggtgaaaaccttcaatagcctcttttctagttattttgtaataaacaatattttactgttaatcatagtcaccctaccatgcaataaaataccagaatgtatttctcctatctggctgttgattgtagttttaattcttttcttaaatatgaagcttctgtaacttcaactggtctgtgaaaatattatgccaaatagaaagcactttttgtaaataaagggcgtgtgatgcactatgaacacctcccaaatgatttggaggaaaaaaacatcaattccagtgatattgtttcagattatcccaatggtctaggtttattccaaagactttgacctaaatccctcagtattccccttcaactaactctcaacccatttgaaatcttattcatatgttctcactgttagattgtccacctacaatttttttttgtcctttgaattactttctactgaaaataatacacagacctcggtgttattggaaattgcattgtgaatacacaaggttttttgtctaaattttaggtagttttctctttctgttgctacctcaaagagataacagattctgcagtcacattatatgtaaattatgtacaagcttcaccacttgggcttgtacattattctactgattttctacagtggcgtggggggcacataatagccagcaacaaattattagaaattaaattcaaacccagtgtatgctggatatgagcatttccaatgcattttgcctccaatttagttcagatgactaaaaacagacctgtgggactgtttaaaggcactaaatctccacagaatcatgcagtgctatgacataggcattctgttctcaaatattcatcatttatcagcaacggaaacaaacataggattcacatgtgcaaagtaacaaaatagatggtcctagctgacataccagtttgactcaactgactattacccttacaatgagcagcttcttaaaccacacttatcctggtcccctttatctatgttagagaaacaagaccatctctactattaattctgtctcaaaacttcaggttacctagttttttccctcaaagattattcatcttcgacagtcaccactgcttcacaaaacagattttattgttttctttgccaattaagggctccccaagaacagtgaataatctgtcaggttgttataaaccatcaaaagttctagaaatgtcacattacctccttcaaatattttttaacatgcaacagggacatacagctttgtcatcaaaagctgtattggtttcctcatattttctaatctacaccataaagggaagatgtttatcataatggcaaaataaataatttagccagtccaaatctcttacaattgcatgtggcaaaccaaagtcaaactgaaggagaggagggtggaatagaggttaatttgctcacatgacaagaagccttgtgactttatttaggataggtctaggcagtgaggctggtaaacatttaacaatatactcatttaaaaaaaaaaagggcagggggtaggagggggctgacttgcagccaatttcaagctaccaacacgctgtcaaccagctcacagaattcctgaacatttaacaataggctattgtatgctgggatgagccatccccagcatgatactagatccagctatcaaacaatatcataaacaccccatcctctcttctctttttcctgctttacttcatctgatttcattctcaaacagatttactcaaagatgactgcagaggaatgttctcagagggctctaaataggttggctttggatctgccctcttaaaactaaacattaccacagaggaatgaagtattctgatcacccagtttgggagctagagagaatgggggtagctacgttcaaaccatttggatgaggcaggactcgcctgaaatggggtaagtgtagccctcctaagaaagaagcactgtgcggatgaacatcatgaacaccatccaagtttcaacatgtctgagattaaatctgcagcaaaagtttactccatttctgggtgtgtaaagcagctaaaacttcctaccatgcgtccgctatccatggaaatccggaacaaaagcttaagatccaagaaaataaaatgtgttttgaagaaaaatatgctcttgcaacataaagaagctgtcttcagttacaaatagatataaaatgtgaagatatataattgctgcataaatttattaatagaagtgctaatgccataaatcgtacatctccattttgacacgcaatcctttattttcctttcactgaggaagaaaaataaaggagcggaactggtaatattgcttgcaactaaattggattttccaccagagaaagctgtttagaaaaagctattctaaaaaagcaaaatagtactcacaaaagggtattaatgaatccaaccaggaggaaaaagcctccaacaatacaaagctttccaaaacctctttcaggactgaaagccaaaaggatgctttgaactctctgtctttgcagaaaccatctcacctacaaaccgagtatgagatagagttcaaattttagaataagaactcttaattcaaactacaagtcttaactgacgattcaagaggagagactgcagcagctctgggtttcgaaggaaaccgatacatcctgccctcaaactgtgaggcactataggagcaagatgtaaaggatgcagtgcctttgcgctcccacctccgccaccgtgggtgtcataatacagaggtgaaagttcaacatgcgacaggtagggatgcagcagactctgtggctttatactgcataggtctttcactgcttggtcacagaatttctttgaatcctatttgtttatacactgatatttatgtaataacaaaagagtaagtaaagagcaaggaaacagccaagaaaccctgagcaaatttttttccccctaagaataaaggagttgagttaggctatcttcccggagcttctctttatcgctagatgcagtcagctggaaacatatgcctgctaattgctgaatgtgtgcctcatggagcaacggtgcagttgtcgaacgacctcggggaaacaagtctaggcctatttgtgcatttctttctttcaccatgggactcaagtgcttcgccaggccactattaggacagtggaaaatcaaggtggaaggctctgatgaaatcaattatcactaagttattttcactggtgaaggggtttcctcacaggggtttaatagtaaattattctttccatgggatgtgctagattaatggaggaaacaaagcaaacaaatgttgcctggtaagactaagaggagggtcccaaaatactaatatttactgcccatgaagagatagccacattcacaagaaaataaatgtaaacctacaattccagaggcgaaaaggaaaaagaaatgctaaatggcagttatttcctcagtgttatacattacacatatcaataaaccctagagtcccatactatacatgccatatggatagataaatggcatatgtggtaatagtctttcaaactggatgatagtactttgcacaagtcagggatgcagcaattgtttgaaaatagggaaaataaccattttctagcattacctagtgaaatgtaagtgtgggtacagtttgggagaatctgtatagtatttatttttatcctagcaaactatactttacctttctggtagaattttaactttggatattttacaaatatcatatatagtcttggtaacatcttttatttaaaatcacaaatattagttggatagatgtgttaagggagatttaccagactgcatacacaaaggaggccatcagacatgggcatctgaattgatataggttacaccacaccgtagttaaagaccaaatatctgccagtgttcccaataaggaaagataactaagataaaagaatgtctcttgcagaattaagaccttgggattcttttaaagcctgggtttacatcctttgctcagaagagaaagacacattatttcaatatattttcattcattcttaggcattaactgtcttaataaaggcagtgcttctcacttaaaaaataaatttagctttaacaaagtaagtgtaaacgtgaccctaattttcactctgctgtcctttcttccctgttgtgcttattagctgctgctctttgaccttgaacagtaatcctttgagcatgcctccttccaccatcaagaggaggttccctacggtctggtagtatttctatcatagttgttgacatgccagggaaaataatttcctttggacactataacccttctcgaaaccagctccttcaaacaactcacctaattgaacgtgaaagacatgaaaccactggtgtcagaaattaaatataggtgtttctttgttttctttggcatttcttctatttactttctgtcatctatgccataggatttagaaaggaaagctatggaaataggcaccatcaactagaactcaaagagagaattttgtatgaggaacacagtccaccagcagaaatagaatagtgttggatatactcttcaacatgcttttttttttttcaggatcaatgttgatggactgtattgaaaacaaaagggtaattcttctatggagttgtcttgcaaaattctattctagggttttgtctttgtcctttgtaagcacaaagcaaatgagaaaacaagtatatggtattttgatcaaaatatatctgccattaaacctaaggttccggagctccatggtatctggaagatgctttagagggtaggtagcctgaaggtgctgcggtgccatcaaagggcaatgaacatctgttgccccatagcccctttcctcctcctccagcaacaaccctgacatcatttgggaattcaatcatctcctcctctcagtctataaggtcgcagtagaattccatccttagacatgaagaatgtgcctcaggccaagctaagaggcacatcttactcccctatgcccctacccccctacccccctacccatagagatttgctgtgggatagacacatgacctaatccattctaatcagggtgactctcaggatgtctacaggagctataatgaaagagttgtaatgtctacagcagaaataatgtcttctgctggagcttctgcagccatcctgccaccactggttaggctggataaaaggcaaacctttaagccttttttttttttttttttttttttggtgaccaagttttgctacttgttgcccaggctggagtgcagtggcgcaatctcagctcactgcaacctctgcctctggggttcaagtgattctcctgcctcagccttcctgagtagctaggattacaggcatgcgccccccacgcccggctcattttgtatttttagtagagatggggtttctccatattggtcaggctggtctcgagctcctgacctcaggtggtccacccaccttggcctcccaaagtgctgggattacaggcatgagccactgtgcccggcctgcctttaagcatttaatgggatgttaggaatacggtactgtaatttctccttgggtataaaatatattggagtcaatcactgttgcccctaccctagtggggatatggcaatgatctcaccccataaggcaaacactagaaatttatgcttcagaattccatctggctttggttactttttgatacttatgattattatttttatttgaaacagaggctcactatgttttccaggctggacttgcattctttagtctcaggtgattctcccacctcagtctcgaaagtcgctgagactataggtgtgcaccttaattattttaagaaaagaatgtaatggctgggtgcagtcgctcacacctgcaatcccagaactttaggaggctgaggcgggcagaccgcctgagctcaggagttcgagaccagcctggccaacatggtgaaaccccttctctattaaaaagataaaaacttagccaagcatggtggcgcatgcctgtagtcccagctacttgggaggctgaggtaggagaattgcttgaacccaggaggcagaggttgcagtgagccgagattgtgccactgcactacagcctgggtgacagagctagactccgcctcaaaaaaaaaaaaaggatttaatttttaaaaatcagcatgaactgaaatttacttcacaatggaattaaagacccccaacaagtcataatatgcttatatggcaatatcacattgtttgtgtgagttataaagttggatggatttgcactggcatcttttcacggttttagtgagagaatcatgcatcatccaaggaactctgatgtaaaagactggacatgagaattattacagctttgaaattctgtcaatttcctacccatttagtcagatttaagaacagtatgaacctatcttacccaaaaaaataggttctaaagtcagtacataaattatataatcatgtgatatgactttatcatatcagtttacattcctgaatataatatggtccaatatcttcaaaacatatcaagactctgatcacttcttaccattcacaccattatcatcaagttgaaaccaccatcacctgttttctgagttacttccaaagcctcctaatcagtccaaacttagtcccatgcaatgtattcttcaaagaaccagtaaattcttttaaaaaataaataaacagatgagatcacagcactacttaacacctctaacgtcctcccattgcaaaatctgtaccgtgacttacaaggtcttctcgatttgatttgccccatccctatccatctaatcccaattcctaccactctccctctctctcacaaagcttcagccccactgtctttcttgctgttccttcaacattccaagatctttctctcctcgggggctttaaaccttcctacctctgcctgcaattgttttcctcttaatacttccaaggtctcccttttgaatccattcagtttactgcaccaatctcatatcttcaaaaagtttttcctagacctcctaacaaaaataaggcccctttcctaatactcactatccccttattttcctcctagcacctgcaactatataatttccctgttgacatgctgattatccatcttatccactgaaatataatccctatgggcacaagtacttttgtttatttgctgctgaatcatagcatcaagcatagagcctggcacctataaattgctctataaatttctggtgaataaatgaatcaatcaataaatgaatcttccaacaacatgatgcaacacagaccaacgttcagatcctacaaggtctaataatgtggctaaaggggcacctgttcttggttccctttggtgaaaacctgataatcaatgaatggcaagcatatttacatatttaaaagtttgcctgcaaggtaatcttaccttgaggctgtgtaataggagtaagtatctattagctcgtaggaagcacatgcacacatgtatgtacacacataaactactctgatctctcatgtcttcaacaacttgactacatttttacctgaaaaaattattgtagctattactaatgtgatgcactaaccagagagcagaaacaaattgagttgtttgtttctccaggagggaaagcaggccgcagctacttccagaaggtcaagagatcagggtatgaatacctaagacatgtgtgtgtatatttctgccacagggagttttcacacaatacacaaatggaggatcaactaacaggctgccagtcaaggggagattcaagaagtttcaaagaaatgctctgaaccccaaaataacaaaggaaaacatgttttgaaaagtacacaaagacagttctcttaaaaatctgccaggactccttgccaaaatggcatgttacacatccccttctctataacctataccatctgggctttccgtaccccaccagcagggtgtaagaatgcctattcatttgcacccctgcccatataagttattataactttttaaaaatcattcccaaacctgtaggttaaaacatgatgtctccctgctttaatttggaggtctctaagttgcttacggtacaacctcaggatccattcatgctcattttgtagctacaaaagaaaaagctctaaaggaaggccaagtgaaatcctggacatgcagtgtgatgaagaaataagggctgctgcttaaccaagagtcaactcaagcagtctctgtgaagttctttctcactgcctctgtttattttcctcctcagccaacacacgactaacagcagcatcttgaatttgcgttacaatttaccaagcacctttattttcctcaatgatcttcataaaaattctgtactatggataagatgactctgttttccagatgcagatccagaaaatggactttccctcagtgtctccagttattaagtagtaaaacccagactagaacctgtgttttctcatggcctcttcaaagttctttctacgatggcatagttccttaagataaaccgagtgaaagaaaggtaactttcactcacaattcaccagaaaaaaaaaaaaaaaaaaaaaagaggaggtgggggagaaagaggtgctacactcagctgagcccacctgtttggtttctgttagctttgaccaaagtgccagtcattacactaaaattctattttgaggtttatcatgaatattggtttctacaaaattcttcattaattaatgctagaaaacacagctctcagtcaattgccatggggcacaatacccaggcactgcttttctttgttcttcccagtcttagggacaccaatccagatagaattacgtccaaaagtagcctaaggccacgtttatgaaataaaaacaccaaggacacaggctgattttagggcaaattttaggtctggcattttatcattctgctctagatctaggggttaaactctactgaaataactatggttgcttttggtggaaacccccttccccaggcccttccagccctggccaggattcaatcatccattcaacagctattcactacacattcacattgtgctaggtgctgggcatacaatgaagaacaagatagacactgcttttgttctttagagatgacatactagtaagagagacacactaaaaacaagtaaacaaacaaagttatgattgactataagtgtaatactctaaaggaaacaaacaggggcactaatggagaataacgaaggcaccttctttgtttagggtggccaagcaaggcctccctggaaagtaagttagtaacagaactgccattaacccacttaggcctagtgttccattactggaatgccaagcatgtgggagttatccatatcctactgctcaaagtcatcgccaaggtctgatttttcactcatgcaaaaattcaaaaaattacaacctccggcatatatgagtcaataagcattccttccttgacctacacatgcttcaatccatattattttccttagtaggtggctgatgaacaggtcaaaaaccaaacaggccatggtagggatggcatcaggcataccgaaaaattctgctttagaaatcagtcatgaaaggtcattccagtttaaattacaatcaacatatagaagctagaaactccaatcagggcaaaaatggcctctttatatcccatcaaggaatcatttatctaagatgacaagaggtatattgccaacaaatccacaattctgtttccaattaatgcaaacttataatattccaagctgttattagatttcaattaataacctgtgatgcctcattaatgcaaatatgctcttcgtggtgctaaaccttcattagtgaaatgggtccaatgacatgacggtttcatatgataatggaactatgattaaaaggcacaattaatcattttcttctactacataatctctgtgacagtttacttatgcctatatgaagcatttgtttcttgcaaacagtcaatttatatttaaactattcaatagcagaaagaaaagcagaaatatcatactaaattatctctaatagttgcaaagaatcccagcaccaagttaggttgttcaagaataaggaccaggcacgatggctcacatacacctgtaatccgagcatcttgggaggccaaggtgagaggatcacttgagcctaagagtttgagaccactctgggcaacatagtgagatcccagttttacaaaaaaaaattagccaggcatgcacctgtactctcagctactcgggagactgaggtgggaggaccacctgagcccaggaggtcgaggctgcataagccatgatcatgccactgcactacagcctgggtgacagagtcaaaaaaaaaaaaaaaaaagtcacagagctggtgccattctccattaagagcataaagtgtgaaacagaaaatctcagtcacacggctgtcagtgctttttctttctcttgtctgtgtactttccattctttgaaccctgaattgctccaccagcaggttcaagccagcaacagatcctgaaccaaacacagcaaaaacaggacactattcccacccctcattttctccccaactaccccacgcagcaaagtctgacttgaagcgaagctgcctggaacagtccattactactacctgcccagtgtccttccccaattctgacaataacactgttttgcctttgcagaactgcccatctctcatatccatgtgggcctggttgggtggtcaattgcaactcttccctcaagcagccagagagagggtcagaagcaaggctgggccatcaaataccccaatactcagcacagtgattgatccaggaatgggctcctgaatccagcagtctcctgggttttttttctgacattcatttactgctaataaagaataccacgttgactccatgcgttagctttgtttgctgtttgtgatttgtggagaatcgcagaagtgaaaagtaacaaacacatgtcaagggccatccaccccactccaacctccacctcaaccgtcacccaagtaaagtccagctcctttagactccctctctctcagtccccagtgttacttattgccaagagacataaagcgtgcaaaagccacacacttctccttctaaagtaaatatagttttaaaaatctattgagatttcattttaattgttgcttagtaaccattgcaagattggaactgtttcctagcttaaaaaataacactataaaaaagatcatttagggccgggtgtgggggctcatgcctgtaatcccagcactttgggaggcccaggctggaggatcatgacgtcaggagttggagaccagcccgaccaacatggtgaaaccccttctctactaaaaatacaaaaattagcagggcgtggtgatgctcctgtaatcccagctactcaggaggctgaggcaggagagttgcttgaacccgggaggcagaggttgcagtgagccgagattgtgccactgcactccagcctgggtgacagagtgagactctgtctcaaaaaaaaaaaaaaattagatatttaaaattaagctgtctaattgttttaaaactcagatgttatagtagctttgcatcggagatacaatcctaaaaaatttaaaacaaaacaaaatgactgggtgcagcggttcacacctggaatcccagcactttgggaggccaaggcggaagaatcactagagcccaggagttcaagaacaacctaggcaacatagtgagatcttgtctctataaaaatttttttttaaattagccggccataatggtgagcacctgtagtcccatctactcaggaggctgaggtgagaggattacttgagcctaagaagttgaggctgcagtgagccatgattgcaccactgactttcacctgggcaatggagtgagaccctgtctcaaaaataaataagtataaagcaaaatgtttgaggattttatttcaataatgccaatctattcctcttcaacgttttgatctaatgtatgaattgtgactctgtcctcttggcaacaaaagtaatgctgggtcttaatcaatgtgcattagtatgctagcaaaatgatacttcttccatatgtagttatatattaaatatatataaaatagaagtgttagatacgactcttatgattaagatatatctttatttaaataactatcccttactggaaaataaatatggatttatacatttttgattaataaatcaatactcatttataatctgatttataaatattttttatttataaacatttattgatttattaagtgcacatgatgtaataatggtttcagtgcctctgccaacaatcactggctgctaagagttgctagagtaatggattgaaaaatgcaaaagggcctgaaagcatggtacgaaagaccacagtgaatgatcggttatgtcggccaaggatgtgggactcagaaatggtagcaggcacatcaagagctttttttaaatctaccgcaacgtggaaaagtccagttgttctaccagtaggtgcttcacctttgtgaagtcacaattctctggctggctgtctactcatctttaaaatgagagttttgattagatgacctcttatgtcccttctagtttgaatattctatgatattctgaaaaaaaataataataatagctcttgtattagcatcccaagcagtctggtgtgggactagctaaatacaggcagcagtgagcttcgaggtgaaagctctgaggaaaaggcagagtagaagaagcaaactttcactgagctgtttagcctggagaatgatacctaaaaagcaaattaccctgtaagaggacttgggaggaaagtgcacagtgaataagtccatcatcttctcccatatattttcaaaaattattcctggaattatgttgcaaaggagtctcaggatgtttgcagccacaggaactggaaactatttcacaaaataggaagtgtagagatcgggcagattcagtgacctcacaatgttatgggtgaccccagatcttctgagctttttgctttagtgaccttgtgaagactttgtcttcaggctagttccctgaatggtgatgagatggctgcatgtagcaattggtgctctttgcttccttgttcggttcctgaaagagactagttgttcttccttagaagcatgagcaaagttctccttaccactatgtggtccaaattggttcctaccagctcatctttgaatctttggcaagacagatggaagtattctgataaggaacaaaagaagaaaaaagcaaacccttgacatctggaaactactcaacacatatagctgggcctcactgttagaaactaacctggcactcatagccaggccacattattatcctgctgggcataaacaatgtcacagaacataaacagctcaagaaaacccactctgagaccatgataaagtaagacaaaacaagactatttcataatttctctctcttttttttttttgagacagaatctctgcccagtctggagtgcaatggcgcaatctctgtgcactgcaacctccgcttccagggttcaaacaattctcctgcctcagcctcctgagtaactaggattacaggcacctgccaccaggcctagctaatttttgtatttttagtagagatggggtttcaccatgttggccaggctggtctcaaactcctgacctcagatgatccgcccgcctctgccttgcaaagtgctgggattacaggcgtaagccaccgcgcccggcctcatactttctctaagcgcagacaaagaaaaggtcactgcacaactcctgagataccaaacatccccgtccattagctactaagagtgactgctacttcattatgaaaaacaggtttagcctcactttagactgtcttccctttagagatgtgagatatccaatcataaaattatccccactttgtgacagcaccctatgcagaatgaatctccctcccttccttagactctcccccaaatcacccaaatgaactccaaattcgttctaacaccctcttactgagatatgctatggttctctgtggtatgtgttctccctcactgcaatgagcaaagaacccaacttcacctccaagtgtgttcctggaggtctctagctagagggcattaattctgattttatactaatgtttgctaacctttttcattattaccccccaaggagcctctttagacttttttttctaatcatcccccaccatttaattccacagatatactgtatatgtttgaggggagggggtttgaaagagggtctcactttgttgcccaggcgggagtgcagtaacccgatcatggctctctgcagcctcaacctcctgggctcagatgatcctcctgcctcagccctccaactagctgagactacaggtgcctgccaccacacccagctaatttttgtatttttagcagagacagggttttgccatgttacccaggctggtctcaaactcctaggctcaaaggatccacccaccttggtctcccaaagtgctggaattataggtgtgggccataatgcccagccgatgtgtgttttttatatagaaagggtaagattctctcccccatacatatcctcacaagccaattttcgtatggtttaaattaaattataagggggtagaaaggaagttgaagagtctaccacaatacgttaaaaagcacacaccttcttagcaatctacctttttagtacagtaatagtaacactcaatgctttttagcactttccacacaccaggcattgcttttatacatctattaattttacacagattaaataattttatccatccaaaaaatctacatggtagatgctagaattatccccagttcaaagctgaggaaactgaaggacaaatgagccaagtgtcatgccccaagtcactaggttaataaatggtggagacaccaaataactgccctctaactccagggaacatgctcataaccatgaggacacattgcctcacactcaacagcggctccagaaacactccgctcaatgcgtgcacaaatgagcaaacgagagtcataatttgcatgatactacactgccttgttccaaatacaaacaaggcagtaaaaattacggacataggataagacttaaaactaagatgtctgctatacagagaaacatattgacggaaatctttcggggcaaatttttaaagtctgtgctgcatgactcaaatgtttcagaaaactaatcccattctgtgcttatgtgtgtgtgtgtgtgtgtctgtgtgtctgtgtgtctgtgtgtgtatgtttacaaggtggaaaatgccttggttaagaaagggaggaagagagggaagaggaaaaggtagtatgttttcccctaaaaattagagattccgaagtgatgatgacatcctccaaccgctagatggaacgcagttctcccacaccatggccatgactgctcatttgaacttgctgcttcatggtcataaggccaggacttcctggcttcctcatgagccaccacattttccatatttttagagcattcttcctacagaagaaacctattttgcattgtttttacaactatcttttttgttgttgttctaatgttgccaaggaatcaagaacctcaaaacctatcttcttctgaggtcaagccatccactcacaggacttctcaagctggagcccttagttgagctgattttacacaatcgagtagagaaagaaaatggctttttgtggtgagcatctgctgttttgttaaaaatgtggttaaagacattaacaaaagtgacattaccagctgttgtaatgtcaagcagcttagctaaactgttttttatcaaatgacaacatatgacacccaaatcaattccaaaccaataacacattgttacttgtaaaacagagctgaatgagagtgagaatgagagcatgtgtgtgagtgtgacagagagagagagagagagagaggttaattaaaatacaaattcaaatttctcctgaagtaggaacaacagacaatatgatcctgataattttcattaagaaatttttaactttatcccagacaaagcaaaaaaaaaagacgattatgcaatccatattcttacacaagaaacagtgtatttcttttgtaaaattcttgtaatagcaaaaagatatgacggagtttctggccacttaaaatctgacttggcttctgtccttcagccatatacctcctaacgagtatgacaataacagaagaactgacttgtgtggctatgtttggtctctctatttttatctgcccatcatgtttaattatcaggctattaaaaggtggcaaatcggtagcattgccaactgcgttgtccctatggctgaaaagcctgtggcagttgaaacaaccaaacccttcccatgggcatcacgaagcttgtaaaagcaaaacggcacaacgtctgcctgcctgccatagtcatggccaatcctgaataaatgtttaatttccacaactgtgatgagggtagggcctgatttgtgccagtgcttaggaatctccgggtatttcatgtgcacaattattaatagtgtaattcacaaatgccaagtctacccttaaggcctgagctcagtcctgctctgctagagttggtgtgacttagtcatcaagaaagaagacactttcaagggcatgattcctcctggaagaaaaacaaaggagtgtgcttaggggataggacgcttgccaggaacagaaggtatgctgcacatggagagtgtttcgaggtaggtaactcaggagggacctgcatttgggggaaaaaaaaacccagaaccaacagaagcagcagaaataaacaagcaggtgtgtgcctctatgtctactacatgaaaggaaaacagggctgaaagtcacaatcagcatatggagacacacaaagaggggcacctgggaaaatcaatgtgcatcaggctcgatggtgcctgcttcctccaggagctcactgcattatcacaggtggataaagtcaccccttcaatgggcacaagtagatcactcttctctgctgagattggattaaaggcgacactgatgctaacagcaagaagaaggtaaaccggacgttggaaagaattttcaacagcaaagccacagtacaggacagatcaccaggagaaatgtatggggaaatgttagaaaagtatggaaagccctagaaatttcaaaagtccagctctgtgaggagacagaggaaggggcagaatgacctgaaaggccattctagtgctattactatacataggaaagcttccttgagggcattacgttttaggtttccaataaaggagagaccattttcaatattttttaaaattttgttgtgtcattttataataacttccaatgtagatcttttaattttactcttgcaataaacctgtacattttctatagtcacctgcctatttaagtcctttattacagaagaggtagaatataggccaaatgccagaagtaagggtcggttacaaattctcaagtgcttgtttatttctggattactttattgactcatttatgtaaccaatgagatcgtgcagtccagcctcagtttccctaaatatttagaaaacaggttgaccatgggatcatagtagtggggcatctggttttcttctgatagtgctatttgttaaatattctgtattatcagatgccctactgtgtgcctgtatatagacttcatcttattctaatgctaactttatgaaatgcatttcatttttaccttctttatagatgagaaactcgctagcaatcacaattaatatgaggagaagttaaaattggaacccatgactgatttcagagccaacattttttagtcactacgctatactcctacctataaacttctaaaaacactgttcacaagtacatcattcccctatggcttccctggatattgagagacctggattataattggaatttttgactaaggtaaacatttcaaccacaagacctgatagaatctttcctatgagaattggtctcaggcttacaacaaaactagcaagttcttccagagtacagagcacccctgtttgaggcaagacccagaactttaaaaaattctaacaaaggtcctagtttctcacacagagctcttggttttggataagacgactttagcctaggctggactgaagacatgaggggaagttctgcaaaagacattgtgcacacattatctctttcactgccctatggcccgtaagatgttcctaacctggaaactgagaactgcacaggtcaagtaaggtgtccaaactcacccaggtcctaagaaacagagcacagattcaagcccagttgtatctgcctccaaaatgagtgctcttttctgttacaatacatgctactatgtcacctccaaaggtaggtaggtactacctttacccacacgcgtgttcttgaactccccttacatctcacctaatgtgaaaagcctgcatgaccccctgggacatataaggccctgggtagtccacaaccaccacccctccacgtacacatcagccccctttcttcctgttaactgccacagaagcctccttctgttcctccaaggccccctgtgctttcctttgtacatgtggttcccctgtcaagaaaactgttccctacccatctctgccaccttgctgactcctgctcacccttcagacctccctggaggaagcctctccagcatccctggccaggccagatttctatggtttacagcagagtttctcaccctcaacactgttcacatttggggccgggtgattctttgttgtggggtctgcaccgagcatcatggaaagtttagcagcattcactagatgctggtagcacctacccctcagttctgacaaccagaaatgcctccagacgttgccagaagtccctagaggacaaaatcactcctagttgggaaacactgatctattgctctttagaatcactttccttatcttcagagcactggctccagagcacaggatgtgcttctgtcattctttgaccatctcctccacgtgaaaatgagtttcttaaaggcagagacagtgctggcttctgctcaccctcaaatgtccagtgttcaggggcatgcctggctcaaagcaggattccaacaaaaacattttttttggaatttctccctaaaaaaggtttggtgggagatcataaacttaagtaggtagctagtggaagactgctgaagcttttttgaataaaaaataatgccagcagagttcaggtcaggggaaatgaatccctggcaggatggacattaaccaaacacctaacacatcagcagaactttctgccaaaggtgttgagaggttatcagcagcccccacagcacaaacaggtgtcagaatgacatcccaccaaaatggcagcagggccctaattaaaagaagaggctgttctttcaagtattgccatgcagccatggcactgctgggatgtgtcaaatcacacccatctaaaaacacacaccacgacctgacatctttgcccagctgcaccatcccacgtttccgtgatggatattagaaaataatgtaacctcaactgacaagtttattaagacacagaagacattacagaggcccttttgacattccaatctctaacgcagtcagggggagatgctgacttgccatcattattgaaagtaattggtcaaaaaaaaaaaataaaagaggtgagagagaaggagagcaatcctataaagctgtcaggttaattatttggcctacaggtgtgctcagtgctcttgatctgcctaccactgggcttgccagtgctttgccagtgttttctccaccctcactcctagtttgggatagttcaatctaaagctaagagagtacatttaaagcagaattttaccttggccaagttatttccttgcctaattatacctacgtaccagtccaaatctccattcttccctatggctctgtcctgttggcataccaaactccaattttccaggacagataacccagttagaaacaaccgacttgtgtgaaatgccacagagagtcacaacgcaaaaacaagttttattcagattgaatttaatttcctaggcagtttagatcacagatccgaaacccagacattttcacaagccaggcaaataacctgaatgagtccagtgagtcagatgggagccaaaaggaagtgatgaggatgatgacaaacaggaacagcaggctgtgagctcagtgttagcagagaaaacccaccgtgccagggaagctgctgatgctactccctggctctaggtccaccacacgcagagtagatgctcaattaatattcagtgaatgaatgaatgcctgcccaagcattcaccctgttgtttccatgtctgttatttccaccagaagaatgttttgtaggcttaaatctccagtgccttcagcgcaactgtcatttggaaagtggtgaactttaggaattaaagaatggaaacaaagagtacatgggagtcactaatgcatgtgggagatactattcatgccacttccaagaatggggaatccgtacagctcattgtcataagtgatgttatttccaacttgttatgggtgagcattatttagaatagcttggaagaccacaatattttgcaatagacatggtagcctgtcagggatacaaaatgaagactaagactaagaatgtcaaatgagattataaagatacctatctttgctcaaataagcaaagggaaaaagtacaccctctgcctcttctcctctccttaaattccttttccccttactctctcaaggagtaaatatatatgctcatatataccaacataaaaaggacattggtagaagcaaacaatacagaagagtataacgggaaaaatacaggtcccactactgagaggtgtcctcggtgaacaatttcagggctgtgtgtgtatatttacgtgtgaaacataaataggatcgtgataccttacagcaacttctgtttttttcaccggacatctatggcatttttttatacttacaaaaatgcctcctttgctctttttatctactgttccataaaaactcactttataaacacaaaaggccaatttttctcacattcatcaaggaaaggctcctgtaatattgtgctcttttttctacctccaatattatgtttaagcaaatcatgagaatcaattaaaaagtggctaacattggcttgtttctactgtaaggactgtttttccataatttgggcttgaaaaaaaatagggttgtcaaagcatgaggtaagtagaagagaagcattaaccaggggtgttaggaacaggaaatgtatttttgaggaaggttttggaagaggagttatgcatccaaagggttcagaattatgggccaactattcctatgtacaaattgaagacattatataaacactacaagaactgaatgcatactcatctttggctgctatttcaaacttccagggacaaatatttgtccttattataaacatacatccaatatgtgttaagtgctcagaacatgtcaagcagtgtgctaagcagtacccatgtactatctcacttaattctcagattcaccctgaaagtaaggtactattattatctccagtggaaagatgaaggaattcaggcttaaggctacacaaagattagtgagacagcaaagatgaatcccagcaatctatctccagaacttggaccctatgaccttcacattatacgtttaaaaatgtcacagacagatggacacataaaactgtgttgctttcatgtcctgggtttctcttctaaaagcaaagcatatttttgttttctctttccctaactagatttccattttctttggtgagcttaagggagtgccctgccaccttaataccaaatattatatctagggtgagaaggagagaataggaagagcaagcagcaagggccttcagaaactatttgtacttgcctcccaagatagggcagcttgaccttatccatgtggctgacagtccagttgctctagtcatgcacctgtgagactactttctgctccctaaatatgccaaacacacaccatgctttgcatgggaactctcccacccctcgacactacccagttattcacatgaaggagtcttcactttcatcagatttctgctcaaagactgtctttcccccctttctaagagttctgcctcattaacctcttatcctataatctgttttgtgttatttttggtacttgtggaaataaagtgccatacacagtcaagtgttttgtgaatgtcaccatcactttaagcctcatagatatcccacttctggaacaatagaagtatgatgcttgataactatttgttgactaaaataatacattgcatactacttgaaacacacctcttattctagtaggaattatctaatcaaagtttgtgcatgtatgtaaatatatccatatatacacatgcatatgtgtacacacacacacatatttgcattttgcagtttagactcttaattaccaatagaggaaactcagtaagtagcatgatagaaatgcaactagtataaaccaactgaattacaaacacaggacttagaggataactgggcattgcaataattgtgaaggaagatgcttagtgaatgattagagggcaactatgttctgatatctgtgaatgaactgcacagtcttcattaatttcacagaaaattcatttttgtcctgttgcctatcctgccatgaaagtggagaattgctcagaatctagctttagataataacatttgtaaaaaattaaaatttgtggcagggcgtagtggctcatgcctgtaatcccagcactttgggaggctaaggcagatcagttgagctcaggaatttgaaaccagcctgggcatcacagtgagacctcacctctacagacaaaaagcaaaattagccaggtgtagtggtatgcgcctgtagtcccagctttttggagggggaagatgggctgagcctgagaggttgagaactcagtgagccgtgatcacaccagtgcactccagcctgggtaagagagtgagaccctgtctcaataagtaagtaaataataaacaaatttgttatcaacttgtcctgagttgatcaagttgctatagttaactatgaatttatttctgattttgatgttcatagttgcagaaactccaaaaactcctagtcagtacacagacggaggcctggcaataaacacttgaaagaattgcctgttggatgaatgaatgaaacaagagaccgacagacttcatccctccagagagatatcttctactgcttctctatgattgttaggccgatgtaattaatctaacacatggagcagattttacccttcattttcaagtacattgtctattaacagcgtccatgagccctctgattatgcaaggttcctgttaatggatctctgccaataccaaccatcaagctaatgatctgagcttgccagctccaaggtgaaggaccactcttgggcatatctctccaggactcaaagaagaatcccctctccaaatgatcttggagaagcaggtgtccactctgcctgccagaggctctgccagcacagggtgggggcatcaagggaggagaaaataaaacccagtaattcatatgggttgagattattgacttcactttcaaagaagataaagtgaaaaaggaagaaccgtgtttttgaaaggtaagacaggggacattatcctgcgtttcatcaagtcagctttttcatgtcaggcgatggtatatctcctgtaacttgtcaatggcaccacacagtgaagctaaaaggttgaagattatttttgtaacgattgatactctttctgccacagcagtcaagcatctgaagattcttcctttctctcctctgctctggtgaatccttttaaagttcttgggtgaaagagctgcaaaccccagcagatatcaaacctgaaacactaacttgacatatcgggatgtgtgctgctatattcactgcttggcttcaggccccttccagagcacttgaaatacagttggaggattctttgaatatggggtaaaagtacgtggatgacctagattgtcaaaggattctcttcaaccaaataagaaagtaagtttgggtcagcacatgctatcagctagaaagactgctcaaaattgtgtgtgccaaaataatgaaagaacgtgccaatacgtcaatccacgtttgtttcctgcccccgttcctgccacttcacagctctaaatagaaacacacgaagagaaattccaatgaaacaaaaggaatatctgaaggatctcacagctttcaggggtactgtaataccctgaaaacagtgtggttattccgggctccacaaactaggtagaaataaacatccatcattgcatagggcaggaagaacagcaaaagcatgttggctaatttataaatgtcacatacagtgttctttgtttcattgcatagggaggcaacgtaatgaaaacattaaaaaccatcttttggtgataattgttgttttaaactgacaaattatataagtcaaagtgaaataatctttgcaactccatagagaaacagaaaactattaaggcccttagaaacatcacaacccatgttcccctttcaaaggttagaataatcctgagtatattttgggaaagtaatatcctaagtcagtaaaaggtcagtgacagggaagattcttccacatcttcaggagacaaaaagtcccctggagaagagaaaccaggttccctggtgacattccgcagaaatctccagctgttagaagaacttggatctccgaggccacccaaacttcaacttaagaatgcaacaaagtggggatgaaacagttcccgggagggaggaggtagaataaaaatggaagcaaagctaccctacagcactaatctgtaaacctgcttcaattggcaagaaaaagaggaagtactacacatgcctgaaatgacaatgtagcacatggaatggacctctgctgttttcgatgatccagcattcctcctgattttcctttgggagaatcatttttcacctactcacagttcacatgattggagaaggcgccttctgggtacaggcatataactaaactgaataatccattccctgacttcatctttcctgtgcgagttggtccaaggacttttgttgaaaccactggaagagagtggctttcttgacagcaggttaataagatggatggaggtaatcaggttggcaagtggctgggcaactgtccttatcaccatacaaaggaaatcttccagagaacaaaggaatcacagaaggaagtggatgtgaaagacagccagagattcccaacaatatatgattctgtaaatccaaccatgaatgaagcttggtatccccactatttgagccaataactcctcctgttggctgaagttactttgacatgcattcttatcacttgcaactgataatccatcccacgtgagtataaatgtgaagaaatcattctaagtacatccaccttaccaaatggaccatgttttgctcaccagtgtgaccccagcacttaggacaagagatgatgtgagaagacttcaaattattgttcaataatttttttaatgattatttgttaactcatgaattatcttccatattcatatcttttaaaaatgaaagaaaatcaaagcaggtttctcctttctgtctaaatcctagcaagatcaaacactggggaaaaaaataacattctcccatatctatctgaccccagaaaaattattacttccaaatagtatttagtttttggcagttatttatgaacaggtaatctatataatttaatagataaacctatttaattatctattttttctcccacaaacaggaagaccagtgtcaaaatattgagcaactctcctaagaacaaggcatgcaatctcaaattcctggttttcagaaaaggttaattggacaagcaaaaacaaggagccaacttattggggagaactggaggcctaggaaaaagaaaaggcccaactttctatccccaacagacactttgggaactgataaaattaaacatttttcaaagaccctccatttcctattaccacaagaaagtcaaaatatttctatcttttaatttaactttatcttgcttttctttttgaaattttaatttagggcaatatttctgagggatgctatttttttttaaataccttctttccttcagctaatgtaaaacaaatagttactcctggaaattactttttactattggttccaaagctacaatttgcagcaaataaaaggactcttcccttctacagaaacattcagacaactacatattgagaggaaggtttatgtgtacttggagcctttgggtgatgttctctttggccatatgatgtggtactcccatcagcctgccatttagtgactcctatcaaagcaaacctctctaaaaacagacacttcaaagaagatgactaattgtgggtgccaactggatgctgaattgctgaatttctgaatggtttccatctcattttccaaagaaaatgtaaaatttcagagtaaaattgccacttttcttttttcacgatgtagtatttggtggcttttaaattcacagccttctattcttggaattttttaaattttaaattaactttccttccttcattccacattcatgcattcatttagtcattcattcattcgtttttttggagacaggatcctgtcctgtatacagcccaggctggaatgcagaggcatcattacagttcactgtagcctcgaacttctgggctcaagcaatcctcttgcctcagcctcccaaatagttaggattataaccatgtgccaccctgcccagctattttttttttataaatgggatctcactatgttgcccagatttgtatcatactactggcctcagtgatccctcttgacccctcagatcattaaacatttattaaatgcctttcacgtatcaggtagtgaaccaatgctgagaacataatcatgaacaaaaatccaaacagccccagtttttacagaatatccagattagtaggggagacaggtattattcaaacaagcacataagtttcttaatacaacaaaaggcgcatggctcttcaaatacaagtaacagaggaatgaaactgagctcaggaagtcaggagagctagttaagggagtgaaaatacgagttgagagccaggtagtaaataggcctagaagaagtatgggttttttgtttgtttgtttgtttgtttgctttgagatggactttcattcttgttgcccaggctgcagtgcaatggcacaatctcagctcactgcaacctccatctcccaggtttgagtgattctcctgcctcagcaccccgagtagctgggattacaggcatgcaccaccacgcctggctaattttgtattttttttttttttttagtagacatggagtttctccatgttagtcaggctggtctcgaactcccaacctcaggtgatccgcctgccttggcctcccaaagtgctgggattaaaggcgtgagccactgcaccaggactgaagtgtgttttgttagaataagagaaagaaagacgtgggataggggcagaaaaaatgttgggaaaacggaaagaacagcaggaacagagaccctgtagtggaaaaaacttagtatatgtgaggaactaaaaggcagccagggtggctggatactgagacaaggttggtgtgagatgggcagaggctcctccaagcaggactgtccaggctgttgcaggaaagaggtcttctgtctactagtaatagaaatgatccaatttactccattaaagaaacaaaactggatatattcaacacattttctctgtatctaacatttcagtagaagtgatataaagattgctaccacatattctgcttgcttcacctacatcttactgtatgatatgggtaacgaataaaacacattccccctatctccattctgtatgtatataccattattttatttcatcatggtatctgaaaagcaattataaatcatgattacagcagctgaaatttgctgaagacttactatgagcacggcattggaccaactactttctgtccatttccacactaaaatcagctacaaccttaaacagactgtcccatccaaagctagcctctcaggttgaaagatcatgatggattatgcagcagggacccaccattcccagactggtatcttagggtccagattccatccatcaggcacacctgggaagaaggcaacctcacttggccttctattcaccagtgaatctcaagtatctctaatgatacttgtggtagtgcagttttctgagtcagccaccctggtatgaattagactgggtaaagtgaatgttcatccatggatgcagctttccattttttagtggcttataaccaaggcatactgctcttaggagtttatttcagagaaaaaaagtatgaacagccaccatccttaaatgtacaaccttttctctgcaacagcttgtccttaaatccaggacacaggatgacaaatgggtttccctgccaggtcctgagaggtctgtgggaaggtgaggcctaggcaggagtggagatcaacgaagcatgaaatggtggatgtttccggggctgcagaattttggagaattcctcacgctgtctgctcaactggtctcagttctcagtggactctgtggggtcaggaggagccctttctctgggttttccctctttctccctcagcagagaaaatcgagaaaaggacattaaattcagtgcagtcactgtgggtgctaaaatattttcaggatcaatggtggtgctaaactatctccatgtttctaatatatatatatatatatatatatatatatatgtttttttttttttttgagatcgagtctcactctgtcgctaggctggagtgcagtggcgcgatcttggttcactgcaacctccgcctcctgggttcaagtgattctcctgcttcagcctcccgagtagctgggattgcaggcatctgccaccacgcccagctaatttttgtatttttagtagagacagtttcaccatgttggccaggatggtctccatctcttgacctcctgatccgcccgcctcagcctcccgaagtgctgggattacaggcgtgagccaccgtgcctggcctgtttctaatatttttaagactgaagtgctttttaaaaagaaaaaaaaatcttatggctacaccacaaaaatgcagtgtccttgggtaagggacccacccaagccccttggccttttactttccaggtatcatttttccctttgatagtactcttgtgtctgcaaaaaatgctctgtcttgatatgctcctggactgtaagattttgattgttttgttttatattttgtttatgtttatatgcatcttatatttccctgaaaactaattaacactgttggcctttctaactggaaaaaaagtctattatttttatactagtgttacaaaacagaagttcagagagaaaatataatttggccaaaatcacatggctaatgagaagtcaagttggaacctgattataaatctatttgctttcaaggtccatgcttttttttttcaagctcagataaatttcacataatataaaattaaccatttaaaataaaccactcagtggcatttattaatatcaattcataatattgcacaattatgtctatctagttccaaagcattttcatcatcctaaaataaaacgccatgcccactcagcagttatttcttattttctttttccccagcccctagaaatgaccaacgtgctttctgtctctatggatttacttattctggatatctcatataaatgcaatcatacatttgagtcactacagcagttaacacagtgcctggcacgtagtgaattttaaaaaatataggttgactgtgtgaacgaaaggataggggtggataatgattaaaccaccataaaatcctgagatattgttctaatatccactgcatgctctccacaaatgctccttcgaattttatcttctgtgacgatgacactatgtcaacctatccacagagcccagcagtgttaatgccgcatgttaataaaacacccctctttccccacagagctggatttttataaaatgaagctttagaatctagataaccaggacacagtacactgaatgtctactcctaatatgtttgcacaaagctaaactacacatattgctacctaaaatataaaactaatgtgagtgcctacagaggaaaatgtggaatgctgaatagggtgaaccccctgctattagcctggaaatgatgactctgttgtgaatctgtcctacagggtatctcagggtctgagataatagcataattatatatgctaactcttcctagttataatatcttggaagacaaaagatatagggtaggagggaagaaaagttaagccaaacaaaaagaaaagactaaattatttttactcaacataatgactctttgggaagtctaaatggcaatacgagcaaagttacaatgcatacttcagaaaggagaggtaagatagaagataaaagctgtgcacatttatacacatattctacaatggacaataaaatgagaaatgcacagtttttcagaagggcaacaagaacacctctacctcctctaaaaattaggatatcaccaacaaatcgttcaccaagttagaagctgaagcattttaaaactcaatgctattaacagcatacttgatataagcagaagacagtgggtttcattactgttaactaccctagtacaacccatagaaaccatgactcagtctgaagtagcacactctaatagaacttcctgtgataatagaactgttccagatctgttctgtccaatatggtggccactaaccacatatatttactgagcatttgaaacggggctaatgtagctgaaagacgagttttaaatatcattgagttaattaaactcaaagttaaatttaaatagccacatgtggccaggtgtggtggctcacgcctgtaatgtcagcactttgggaggccaaggaaggtggatcacctgagtcaggagttagagaccagcctggccaacatggcgaaaccccgtctctactaaaaatacaaaaattagccgggcatgttggtatgtgcctgtaatcccagctactcaggaggctgaggcaggagaattgcttgaacccaggaggcaaaggttgcagagagctgagctcgtaccactgcactccagcctgggtgacagagtgagactccatctcaaaacaacaacaacaacaacaaaagccacatactagtagctactatattagagcaactctatcagatattaattagtaaagaatatagaaatactctctagcatagtttacctgcatttcataagggcaatcaaaatagctttaagcatgtgtagtacaggcatacttctcaaactttaaggctgtgtgatatataaacaaacacctggcaactgccatatggaaacggacaaacacctaggtaggtggggtagagatggaacaaagtggaaaaacacaagtcaggtaagtaaaaaagctcatcgagggctgaaatgtcccaaagacttggagagtcaggccttcctaggagctttccatcttacaaagctgagtattggcaaatgttaccagagagatttagcacgaggaggaagctggtttaatgaaaagagctgcgtcaatcatgagccgatggaagtcctgctctagcctttggctatcgagccataaaatccgttgcttggaaatatgaaacccttttggctacttaatgttttctccaattcctctaactcagggaaaaggatcatggaaagaaaccaaggagggcaaagcaaggagaaaggccagaaatccaaagaggaagaccagaaacaggaagaaaaaatacaacataaaattgtgggagaaaaaaaaatgctcatagggagactggatgctcccagggtgaaaatgatgaaaaatctgtgcgaaagagcatgcccaagcagttagcaaagacctttgtgaatttatgtacaaaaccacaaattacacacatgcttcccaggaacaacaaatgctgcccataaaaataaatacctgccattaaaataaataataaggaggggaaggagagagagggtcagggaaataatacaataagccaaggttaaaaaaaaaaaaaagctagaagaagttgaacttgacctagaatttgatagtcagttacttaatccagaaaaaatgaaactgccaggcaaaagtactagcacaactggctatgaaaaaaactaaaggcattcacaaaggtattggtaactcgtcttatgatcagtttctccctaacactaaagtttccaattaaaaataaaaaacaagtgaggtaaaaggaatgattctaactatagtcccttcgcatagaagtaggtcaaaacagaagaggcttactgggatggggaaacagacaaattccattttgtaatacaccatggagaaaggtgtttattgaaagtggcagctttagcaccattgttttgcactctgagattagtgatttttgaatcacctcctatggtattacttttactgtgcatttagcaatgtcagctgagatataattatgccaaacctagtgatatgatcatctacctttcaggttcagctaaagagttctcactccatcaagacttctttttctctgaaaaggattcccactaaaatactgtcatttcctttgctttgtcacaatcacattttggtataggctggactgggtcagtgctgtgaatctgagaggagataatgtacttcaagtcccaaagtattttgagttgctggtatgccacataggattacaatcacaaaagaaagttaatagtgtgactcaatgctgagagtcctagctacgggaaagtgagacaagattggtttcatacctggcagcactagaatttaacgttaatatgaagtgtcctgattagctattatataaaacactgaaagaagaaatttctgttcaggaggtattcagaagaactgaggaggatagctggctatttagtgccagagagccaagtcaacttccaatccccatgggcttcttcagtgcacatgacctatggccaagccccatctttttatttcacaaatgttaacttcccaaatgggttagcaagggaaaactatcattattataaagaagcgcagataaggcagacacaatggctcacacctgtaatcccagcactttgggaggctgaggcgggcggatcacctcaggtcgggagttcgagaccagcctggccaacatggtgaaccctttctgtaataaaaatacaaaaattacctgggtgttgtggcgcacacctgtagtcccagctactcaggagactgaggcagcagaatcacttgaaccctggaggcagaggttgcagtgagccaagatcataccactgcactccagcctggacgacacagcaagactctgttggtggcggtggggggagggagaaagaaaaagcacagatatgtcaagtcagattcacttcatcaactctaagatttaaataatactaacactttactcactatttaaactacgttgtttttcgtccattagctcttcctcagcaatctgatcccatgtgatatatattgaagaaagactttcacagatcaaataaggtagggaaattctgaaaactaaactgtattcctagaaatataccatggtatgagcatattaaagaccctgagaagttctgcagtaaagaaatctgatattgccctctgtattctcctaaagcgttttagcttggggacgattttccctttgttctttatataaaatacgtattaccatctcatattcagagccctataaaatatacttcaagaaatactgaggggccccttaattacactataagactcttaacatacagtaggtttgtaaaaagatagtaaaaaggattaaagattcctcagaattagcttttcatgggcagcaaaagaagtgagaaaagaatggtatttattgctacctaccacgtggccgcattccattaggcgcatttcagtctcagtaaatcaccgcaacaattctctagtaggtatcattattctcttttatgcagaagagaaaaccaaagttcatagatgccacacagcccactcacggtcccagagttaagagacggcagggcagggatttgaaaggcctgtgccctttcccctatatcacagtggtgtaatcttttcacactatgcatacttctataaagcaaaaccattttgaaatatctgtcctgtgtgacatcacaatattgttaatggtttccttctgtttccagttgtctgcttagtataatgaaattaaaccattaaaatggaaatggaacttgttccgtgaccttccctttgtgagaatatgccaaattaaatcaacatgggatttttggaggatgtgccatttttttttaagaacagggtctttctgccaagacaggaaaacttataagaaattcaactacctagctacaggacctcaaatattaggttataatacatgtttctgtaggttgtaagtgtgtaaaaaaaaaaataggttccttcaggtttaagaaatccaaggtcatgaaaacaggcatctggccccagctagaaccctggtctagaacactaaggaaaagctaggccatctttcatttcttcctgacatcttggtctctctaaacgggttctcttcgttctgcatgctacatgaaaggaaacagctaccattaattccccagtattgctctctcctcatatgtgaggtcaaatagattcaagatggaatctgaatgacaattctaaattctctgaggaattagagcccaaccttggaggcaatcctccacggggactatatgtaatatatttatgtaatgtaaatatggccaatggaaattacacagctgtaaccacacaaactgggacaagcagcctctggagagcatggagagcagtggtgtttaggccaccaaaacagcttatacaaagacttgacaaaaagcacacaagctcgtcaatggaaaatttatgagataatgctgaagtgatttttaactaggaagatcacgggcagcaaagtgagtcaagttttaaatgaaaagtagaaaaaatataccgtgctgttgcaacaaaaataacccaacttgtgcttatgctgaagttataaaaaggagaaagagaaaaacttcacacctgcaacagcatcattaaaacataacaggatggtttgggtttgtcagaattaagggccacctgctgttccacacttcaccctcatcccaatcccagtccctgaaagaaatgaaaagaaagctgaaggaattttcatggagacaaaatcgagcagagactggatctgccaaagactatttttctagtcttcaagaaatatcctgaagtactgtttctaacagcttcattttaaaaaatattttagctctttgtttgtcttaggcattcagaatataaaatgtacattttatattttaattctctgttagaaaaacagggcatatgttgtaaaaacgtatggaggtcttcctttataatttgacgttgatgctttttcacagataagcatttatctttcagaatctaaataaaatgccatatttaaattttggaattttaatctgtatctggaagaaccaaacagaattttcaccatctctaaattactggattgcaagattaaagaatcaagtactttgatcttatttaacttgtacagtactcacaaaatttaaaacactgcacatattttaaacaaactaagtaagcatttacttatatttgataatctggatatttttaaattttctattttaaaatgaaggtgagtaggaaaaattacagtctctttaaagtaccatgagttaaactgccacattgatggtaccatttaccaaccagctatgagaagtaacaaaataaagttgcaccaggaatattactattactctctacaatcattacacagattacaaatttttttaatttttttttttttttttttgagactgagtctcactctgtcaccaggctggagtgcagtggtacaatcttggctcactacaacctctgcctcctgggttcaagcgattctcccacctcagcctcccaagtagctgggattacaggtgcccaccaccacatctggctagtttttatgtttttagtagatacggtgttccaccatgttggccaggctggtctcgaactcctgacctcaagtgatctgcccacctcggcctcccaaagtgctgggattacaggtgtgagccacagtgcctgaccccagattacagattatcctcattttacagatgggaacatctaggttcaaaaaggtaaaggaatttcccaaggatatatagctataggctaggattcatggcctggtctaatgtcagaagcaccccctattaccactggcatcaacagaagaccagagtagagtttaggttgttagtaaagacatgtttaataagcacaaagcctcttggtaataattaaaattgaaaatcttcatacagatttgtgatctggtctcacaaagtgaaaagctcaatgcatttcttttgcatttattgactttaattttcatttccatagctctttatagccttcaagatattgtcacattatctcattctgacagttatatccttcatattttagcatttattaagttgttacatgtctgactccaaaagaaatggaggtacaccctcctatatatatctctacctgtgatacatcatagcaatcaccttatgcatgatgctctgaaaaacaaatccgaaatatgcaacagcctagataaatgggatcacaaaatccctggtggggacttttaattatatgctaagtaagaggcaggttatgcagaactttctgaaaaaggggcagagggttttcagaacgatatgagataacttctaggctgttgccatggcacttgtaaactgtcctggcgccaatgggagtgtctttatgctaatgagcaatgaaggcaactagaggttgctttcctccccacctggtagttttggctggcttcttcactgcatctgaaaacgggattgactaaatcctgcttctattagtgggaccatgacctgaaaacaaatcctacaggcctcctacctcaacaaggcagcatcaactgttctcacaataaaccaaatatcaatgattccatgatttggtgagagcactgcctattagcatctttaagtagcacaaaacatggcagcagacgctctccttcatattaggttgcatctagtcactaggcaaaatcttggttagtttcctttcattttaaattttgctcagaggcccagtgggcacagtggctgacacctgtaatcctagcactttgggaggctgaggcaggcagacagcttgagccccagagttttgagaccagcctgggcaacatggcaagttcctgtctctacaaaaaaatataacaacaaaaaagtcaggcacagcagcacaaacctgtagtcccagctacttgggaggctgaggtaggaggatcacttgagcctgggagcttgacactgcagtgagctatgatggcaccactgcactgcagcctgggtgacagagtgagaccctgtcttgatcaatcaatcaatcaatcaatacttgtccaaatgagttgttagttcctccttttattctctataaatgctgccagtcgggggcagtgtgtaaaaagcagaaaaacaaagtcaaaaaataatggagggttaaaaaaaaaaaaagaaaaaaaagaaaaaacaatggagggttccactcctttaaaagatattctgtccatgacaactccccctctgcccatttcctgaaagaataaaaaggatatgtagttctttctctctgacatcttctgaataaagtatcaccttcaattcaaacaggtaaaatatcttgaaaaagtggtcagaggagctggccaggcacggtggctcacacctgcaatcccagcactttgggaggccgaggcgtgcacatcacttgaggtcaggagtttgagaacatcctagccgacatggtgaaaatccatctctactaaaaatacaaaaattagctaggtgtggtggtgcatgcctgtaatcccagctacttgggaggcttaggcaggagaatcacttgaacccaggaggcagaggttgcagtgagctgaaatcacaccagtgcactcaaatctgggcaacagagtgagactctgtctcaaacaaagaaacaaataaacaaacaaacaaaaaaataaaagtggtatgatggaggattgttttgaaagtgttttgttcaatttgaagtcaacaccgtgactaacaagtttgactgacagtgtccctcaatcagacacacttagaagctccacagacttgaccagaggttccacagacattctgggtacttcaaaaaatcacaccacaggctcaagtgtgccatgtcacactcttttcaaaacttgacaatgccaagtcaatcaaggaaactgattaagtgatgccgacaccctcttgcctccccagaatccctttaaaaccaagaccaactgtgtccaatctctattagggccagtaacttttactaagaaaaaatatttcctactgtggcccagatcctgatgacagtcaacagcgttaacgtttttactttttaattttagactagttttaaatctacagaaaaattataaagagttcagagttcccatatatgccacacctagtttccactattattagcaacttccatatatgatagagttgttacaatcactgaactagcattcataaattattatttatattaatttatttttcgtttttttttttgagtcagggtctttgccactcaagctggagtacagtgacgtgatcagagctcactgcagcctcaaactcctgggctcaagtgattctcctgcctcagcctcctgagtaactcggattaccgggcattatcacacctaatttgttttttattttttggtagagaccaactcttactatgcttcccagactggtctcagactcttggtgtgagctaccatgcctggcctctgagacattactattaacaaaagcctctattttattgggatttccttagttttcaatctaatatgctttttctactccaggaccccatccaagataccatattaacataacttatgttgcttaagacttttcttagttgtgacagtttatgagacctttactgtttcttatgaccttaatagtactgaggcaagtatgttgctgaagtccctcagttaaggtttgtctgatgtctttctcatgattgcactatgtctatggttttttgggaggaacaccacaaagataaagtgccatactcatcacatcatagcaacgtccatattatcaacatgacttatcaccgatgatgttaaccttgatcactggttgaagtattgtttattcaatttttgcattctgaagttactcttttttcctcctttttaagctgtacactttggacaagaaaccacgtgtggccgacatttaagatgtgagagctaggctccagctccttgcagtatttatgagaactatccggaattctgctaaacagatttttcaattctacctcatttatttgtttattcaatcatttatttccatccctatttattcaaatctttttttatattttgggttataattcaatagtgtttattctgctgttcgaagcgacccatctttggcgcttgggaactccttgagttggctcctatgtccctttaacacactcccattattgtgatttattttgttgtgttttctgagcactgtcttacttcttggcactataacgtgctccaggctcatcatgtatatttcttgctgaagtcccagaatttgccatttctccaaagaaccttggtttcttttattgggaaatggaattagaaacaaagatctgggtgttaggtgtatttgttgctcccacggtttattcgtgaagcagaaatgtaccctggttttagtaaatgcagaatgtcaggtatccaccatttacagcgtcaaattgaatagtttcatggtgtggggaaaaaaaaaaatcgcatgtttcacctattaaacctcaccccagaaccttcagtaacaatgatttgtttaccatctccatggttttgtctttaccagaaagttaataaagttgcatcatgcagtagatagccttttcagactagcttctttccttagcaatatacatttactattcatccatgtttctatgtatagttcattcctttttattgctgagtaatgttccattctacagatgtaacagagcttgtttattcattcacttattgaaggacattttggttgtttccagtttggggaattatgaataaagctgagacaaacattccagtgcagggttttctaatttcataagttttcatatcagttgggtaaatacctaggtatatgactgctggattgtatggtaaaactatgtttaactttgtaggaaactgcaaaactgtctttcaaagcgcctgtgctattttacattctcataagcaatgtatgagagtccttgttgctctacatcctccctattaatggtattgtcagtttttggtatttggtatttgctctacatcctccctattaatggtattgtcacacaccagtggctgtgtgatagtatcatcttgtactaatttgcaactctctaccaacatgtgacgttgaacatcttttcatatgtacgttttccatctgcacatctttagtgagctatgtattcagatcttttgatcatttttaaaattagcttgttttgttttcttactgttgagttgtaagggttctttctatattatggatacaagtcctttatcagatttgtattttgtgttctcccagactctggcttggcttttttcttcatagtgtcttttgcatagcttaagttttcattttaattaagtgtaacttacgatttttttcatgcattatgtttttggtggtgtatatacctactaacacattaccaaatacaagatcccagatttttttctagattttatacttttgcatttcacatttaggtctattattcatttgagtttttttgtgacatatgcaaggtctttgcttaagttcatatttttacagtggatgttcaactgttctaccaccatttgttgaaaagttatcctttctccatgtagtcacttttgtgcccttgtcaaaggttgactgaatttgtgtgagttagtcaactgtttttcaaaaaggctcagcattttcgaaaatccaagaaaacaggaaggtttaacttgaagccaagagcaacttgacagtggcagggcaatgtcatcactactgtgtatgtaggtcaaaccaagaatgttacacagtcataacggaggtgggctgcgtacagaacaccctgcatctcctaaatggtttataatcactgattaatcctctgtgagtatagacgggcctcattagctctagtaacaaggaaagacagtgttagattgataaagctaaggttgggaaagagaaattagagcagaagagctgtaaaaaggatggaaagtgccatgcccgcaaactttgtagatggatgtttttattgtatttgtttttttttttaacaaataccaccatcttttcattttcttcctatgttctacactccctcaaattaggaggcataagatatttaaattcaaatgggagctttctactctagctcccactgatgtgtatttcttattaaagctttgtgattattttgtattttaccagttcatgcccgtagagtgttgaggcctattttatcaaaactgaaatagctcgtgattagagcttacttaaaatatgcaaaccaagacaaggtcaaagcaacctttctttcagagggtcctgtgggggatcaaatggtatacattgtgattcattttcattcttcttctgtgtgtttacccatgatggccagggaacacaaaatacaagcctctcactggagtcagcgtgcaaaatgtgaaaccccctaatgtcaaactgcaatcaacacatcacaagcctgtcattaaattggcttcacaaaataaaagtgagaaaaaagacaaatgaagttaccacacgtaatacagaattgaagtggatgaggctgaagtttagaagagaagttgtcctctgaggaccgaagtataaatgcagtttttaaattaggccatggagggaaactcttggattgttccattgctggtgccctcggaagccttcacgggtttcctgtgaaacacgcaatgtaaagcagtgaatgcagaatatttgatcctatctttgtgttaatgagtcttcaatctagagagtgggtgatcacttacaaaaatggccttctgctgactcaccagccctgcctattacattcaccctgctcctgcacaaagccagaaaaactgaacaacaagcagcaaataaatttcaataaacagatttattgtcctatttcaatacaaatcacagtctattaagaataatgcactctagtccaggttctgacagtcaaagatgctgatttaagaagagaattgtgctcctaatttaattcattcatttgcatctctctcttctaagtatgatataattcagccttactgatcatagctggtaatcactcctctgttttatggttaaaattgtgcttttaaaaaattacaattctacctatttatgtggggatttttatatattatggttctaggatgaatggttattagatgacaataatgaaaaaggcaaggtttatcaaagtgacctctgaaattaccccatacattttcaaaatgatgcacctgtattacacagagcatcatagattccaagcacattttccataactaatgatatgacttggaccatctacaccttttgtcagcactgttttctgatttcaacatagtacaatccattgaatgtcagactctaacaggtgtctatgaactcagggatcttgacagtttctttcttttttttttttttttttttaccattattacattaaaggcaaacagaattcagttccttcaaaattagacattttcaacttatgtcccagctttctgttattccacctcacttttgtacttggtaaaataaatagatcacaccgtagatgctgacatgcttctatcacatattatgatattttggctttattttttagttgaaaaagtgactgtattttgtaaaattatacacaaccaagagtttaaattggattcaatgtgtgtatgctttccgctgaatgattcctttttctctgggtcttgcctcaaacaagaaaccattaatgagtagtgaaagctttggacacagattttgtgaagtttcatatgagttaaggagtgccttcatttcatccttcaaattttgacagtaactatttttataaagaaattaattcagcttttccaaacttctttacattgcatcataatatatatcacaccatgatgacaaacattgaatctatttctattaaagacaaacatgcacaatttccatctcaagtgaaatcttgagcaaggatggaaacttctcaaagaaagaaaaaatagtaagccaccttgtattcttaagaatgcagaatttcaaaatgagacatttctgagctgcctctcacaaagcaattttttttttagccgcagggcaccccagtagaagttaaaaatagattacacttctattcatctaaaagaaggacactaatatgagcactgtagctttctgcacttcagtaaaaatcagaaatgatctgcagcccggtgaataaagttgattcacttagagaacaccagcatttctctcctcacctagcttttgaaagcaagcatgagacagcccctgcctacaaaattgcagaggaattactctcaattacaggcttctgtctgttaaaaagtagagctggtgatcagtctgaccttttttctctgacaagtcaaataaatgaaagggaaaaaaaaatctgacaggtgttcaatttagaagctgggggtgggggggaaagaggagaaagaaaagaaaagcttgtattctctaactagatctccggatttttttgtattattcatcctattttaaaagttccttttcagtgaataaattgcatgtggcaatgtaattttcttaaagtcactcacctaatgttttaatttgagtatcatttactgaaatcttcccacaatcaatcattcaggcttttagtttcatactttagatactttagggcaattctgctgaatgctacaactccgccctacccccattcttccttccttcttataagtagattacaaatgaccacagaagaatgacttttctggttccctgcatttgctatatttattgcaagacatggcttgtaaacaccagcctccacattttacctgataatgcgatcattacagaattcactagaatttggtcggcattggtattatttgaatgtgaatgttttagtaatgacatgaatcgtttttcagctctctgacatttacccacgttttttcatttcaaaagagttaactactttgctaaggactgaaaaagttgttctgatgaaagttaaattctaaaacattctgtattcttcggagttggttggttaggttcttgataatccagcacttgttcagcaaaactactaattagaggtggaagccatgtatgcattgaacagttacctcttcaagtttcaaagagagaagaaggaccaaaggatgctctttcccttaggaacccatctgacctgcatttaggccagttaatgatgacttccattcagctttgaaacatgtttcttttaagtcagctacttttcagtagggaaaaactattttgagaattaatcattctcaaacatcatacagaagccaaccagttaaaataccacaatcttaaacagacctgcaaacaacatttggaaagttgaattgtgattgactgatgacatcacagaaccaaaataacgtcccacattcacttcttgctctgttatttttgtttgcttcataacagtcagaactgcttttctgagatggctgagacagttttctcagaaatgacgcagtgaaatggctaatggccagagagtgggagtgagatgagaccagaaaaaaaaaaaagaaaaactaaaagaaaaaaggtggaaaagaacaaaggtgatgtacacatacccctaaaagctggccaaaagatagttatagtaaaaattctaagggagggctgggcacggtggctcacacctgtaatcccagcactttaggagtccaaagcaggcagatcacctgaggtcaggagtttgagaccagcctggccaacatggtgaaaccgtgtctctactaaaaatacaacatcactggggactgttgtggggtgggggagcagggagggatagcattaggagatatacctaatgctaaatgacgagttaatgggtgcagcacaccagcatggcacatgtatacatatgtaactaacctgcacattgtgcacatgtaccctaaaacttaaagtataataataataaaatttaaaaaaaatacaaaaattagctgggcatggtagtgcacacgtgtagtcccagctacttggggaactgaggcatgagaatcccttgaatccgggaggtggaggttgcagtgagccgagattgcacccttgcactccagcctgagcaacagagtgagactccatctcaaaaaaaaactaagggagattttgaagttgtgtctttttcctgtgactgggaggccctgggaagctaagaaaattttattgaacatctgctttgcttccaggagataaagtcttcctgatacttccttctaatttaagtgaggcagtatcccacaattaaaaaaataaaataaaataaaaaaacaatggttcctttctccaaagagtcagccagcaatgatcaagaaaacagcacagtggtgtatactatacagctttggtaccaatgccaacaacccaaagtgataaaaaattaagaacagaatttatacaaaaataatgcttaaacacatgttttattaaaagctatagaaaaagggatacatttgaaataaaaatagcagtattttctgctttaataaccaactgttgactagtctcgtacttagaaaacggcaggttgtcacctagtgaactactcaaaaatctctctaactagcaagataaaaagcagtatttcaagtccactgaactgaaatgaacataccatacgaacataatggcagtgtacattgctcacatacaaaaccacatcataaagccgtagtgattagaagggcatagtgaccaaagcatgatcctctcctccagaaacagactcaaacacacagaaaagtagtatttttttatatgacattgcaaattcatgaggccagatgaattaatcaacaaatgttattttgggaaagtgaggacattgaaaagaatgtgaaccctacctcacaccttatcccaaataaattggagacagattaaagattaaaaattttaaaaataaaaatgtttcatttaaaacataaagcattgaaaacagcaaaatgatttaaaatacttttaaaaagtcatttttaaacatttttacagtgggagaaacccaaaagaaaagactaacaaagccaattacagaaaatgaaaagttcagataatacaaaccaaacagaaaacaaaccaaaacacctacaatcaaaaaaataaaggtaaaaggctgggtgtggtggctcacacctgtaatcccagcactgaggattggagactgaggcgggtggattacttgagaccaggagttcgagaccagcctagcaaacatggcgaaaccctgtctctaccaaaaatataaaaattaccaaagcatggtggtgggtgcctgtaatcccagctactcaggaggcggaggcaagagaatcgctcgagcccgggaggcggaggttgcagtgagctgagttcacgtcactgcactccagcctgggcaacagagcaacactatgtctcaaaaaaaaaaaaaaaaaagttaaaggatagacaggcaaaagttcaatggcctttgaaaaaggtaaactgagggctgctgaaagccctaaagcaaggagacaaatgcagatgtaggtttaggactcagcatgaatgctgtggctggagacatggggtatggcagatgcctttcatgaaagccaacagagactcatctccctacctcccaaatggctgtggaggagtttccgttctgtgactctacctctcctgtatgggtggacacgtaaccagaggtaagcatctgatctatgaacaatcaacacagagattgagttgagccatgctctctacagggcattcagaagtaaatgggatttccaagttcaattagcagagttgcctgcatctcatatttgacacctttaccctacatgctgcttacctgcccaggatctgaacttctggatatgtatctttatttcaccccacactctgagtcctaactttctaccctctaaaatgattccaccaccatccgtgaaagcagaactgataactacaggctgcgtgactcatgtttggttttgacttttcgtaaccacgatccacattaagagctttttcaaataattgtttataggttatatgaacttcataattttgaatgacacaagtttctactgaagtgattggtctgccacttccactgccagtgaaagaatattctctctgtgttcttaaaatcattcattctaaatgacactggggtaagatgaccgaaaactaaagggatgacattttgcttaaaaggtagaattgtaaacaccagactgcactcagaaaaatggagatttctcaaaatttaaaatcctcaaccatgagaaggataattaacaaaatacacttcagaaatatgaacacttagaatgcacttagtcactttacgagaactactgtaatcgtgcccaagcctaaatgcggatgtgagtataatcactgaccagttgcagcaacactgctgctgagaatggacctgcatcagaagacatgccgagggacagagctggtctcagcacccttaggtttcaatgcatgtaagagccagtgttcaggctgcaaaggtctgggcatttgtctttccaggctaacagaggaggagacaatgagactctacatcaatttcccagtatattctgcaaagtgataatgaatttctaaaagaaaactaaataaaaatatcatttagttggctaaagagcttccagaagaaaggcctcagaccatttcaaaaagaaaatggacaactctcaaacacagggacatagatgaggcagaaaagaagaaatatgcatacctataaccatggccttgacaagtcattttatagaaaggtaagatccaagtcttgaggcacttgctcaagcattcaaatatttctggggccaatcaagtgctggctgtggagatgccacatcctgaccctgcaaacagtttagtgggggacacaggctttcacatatatgactgtagcacagtgtgatatgtccaatgtcaggggccagtaatgagaacatgggggcaggaaaggaaggagagagtcctcacacctcagccaaagtggttcaggaaaacatcccaggaaaagaggtgtttgatatgggtgttaaaaaatgggctcgctttccaatctaaagaacttgaaagtatcatagacgacacaaatgtgaagacatccaatgatcatggattggaagaatatcatgaaaatgatcataatctgattatccaaagcaatctacagagtcaatgcaattcctatcaaaaaaccatttttttcacagaaatagaaaactcaatcctaaagttcgcatatggaaccaaaaagagcccaaatagccaaagaaatcctaaacggaacaaatctagaggcaacacattgcctgacttcaaattatactacaaagcaatagtaaccaagacagcatggtactagtataaaagtagatttataggccaatggaacagaatagggaacctagaaataaagctaaatacttaggaccaagtgatctgaaacaaagcattaaaaaacataaactggggaaaggacactctatttaataaatggtactgggaaacctggatagccccatgtagaagaattaaacgggatccttatctctcatcatatacaaaaatcaactcaagagggattaaagacctaaatctaagacatgaaaccataaaaatcttagaagaaaacctaggaaaaactcttctggatattggcctaggcaaacaatctatgactaagactccaaagcaaatgaaacaaaaacaaaaatgaataaatgatacctaattaaactaaaaagcttctgcacagcaaaagaaacaatcatcacagtaaaaagcccacagaatgggtgaaaatatttgcaaactatgcatctgacaaaggactaatatccagaatctgctaggaactcaaacaaatcagcaaggataaaaaacaaataatcccattaaaaaatgggcaaaggacatgaacagacatttctcaaaagaagatatacaagtggccaccaaacatgaaaaaaatgctcaacatcactcatcatcagggaaatgcaaattaaaaccacagtgagggctgggtgcggtggctcacacctgtaatcccagcaccttaggaggccgaggagggtggatcacctgaagtcaggagttctagaccagcctggccaacatggagaaacgctgtaacaactaaaaatacaaacattagccaggcatagcggcagggagctgtaatcccagctactcagggggctgaggcaggagaatcacttgaacccagaaggcggacgttgcagttagccaagatcgcgccattccactccagcctgggggacaagaatgagactttgtctcaaaaaaacaaaaacaaacaaccaaaaaaaaccacagtaagacaccattttaccccctccagaatggtcattattaaaaagtccagaaacaatagatgttgacatggatgtggtaaaaaagggaacatttatacacttctggtggaaatgaaattagtacaacctttatggaaaataatatcgtgatttctcaaagatctaaaagttgacctaccattctatcttgcgatcccaatactgggtttctaccgaaaggaaagtaagtcatgagatcaaaaaagacacctgcacacatatatttattgcaacacagttcacaattgaaaagacgtggaaccaacctaagtgaccataaaccaataagcggataaggaaaatgtgatatatatatatatttatatttatataattatatttatatttatatataattatatatatgtatatataattatatatattaatatacatataaacatgatatatatacacacatatatatatgtataccatggaatactactcaaccataaacaagaaaaaaataatgtcttttgcagcaactttcatggaactggaggccattattctaagtgacgtaactcaggaaagaaaaaccaaataccacgtgttctcacatacacagaggagctaagctatggatatgcaaaggcatacagaatgttataatggacactggagactcagaagggagggtgggaggggcgtgggggattttaaaaaactacatattgggtaccatgtgcacaactcaggtgatgcatgccctaaaatttcaggcttgactgctatacaattcatcacataaccaaaacctacttgtacccctaaagctattgaaatttgtttaaacgaaaaaaacttgaaagtgatacagttttaatcaaccagttactgaggatggacatattagtttattattgccgctgtcacaaattaccacatacttagggcttgaaacaacacatatttatcctatcgttttggaagtcagaagtctgaaatggctgtcactggggtaaaaccaaaaagtaagcagggctgtgttccttctgggggctctagttcagaatccattcccttactttgtccagcttctagaggaagcccacattcctcacctcatggtgccttcccacatcttcaaagccagcaacatcaggtcaagtcctgctcacaccacaacactcagacctctgcatccctcatcacaccttctctcactctgactcgcttgcctccctctttcatttataaggacccttgtgaatacattggacctacctgaataataccagataatccccctatcccaaaatttttaacctaatcacatctgcaaagcccatttggtcatgtaaggtaacattcacaggtgttggggattagaattaatacctctttgggggatcattattccacctaccaaagtgggttagggaccacacacccgccctaagtgcagacggaagcagcaatggcctaggatgtgtaacatacatacatacatataaacatatatacagacatacatatataacatatattacacatatatacatgcacacacatatccattacatagatgatatcatacatatatacaatatatacatactatgatagtaaatgttttatttgtaaaaaaaaaaatcaagcaggattatattagtctcatttcttatactttgctatgcttttgtgtgggcaaaaagccgtatggatcatgtactggggaccacaggtaagtacatacagccatgcagacaccccatgcatataaactccatccaacatgtagattactgcaccccaaatagatagatacatatatacgtagacagataaaagaactgcttttcaagtcggtgttccccatagtgtggtacatattccatttactaattcaaactttaaaattcgaaaagcagcatacttaacatgcatttaaaaatatataaccatcatgtcagtcatgatttcataaatgccacagcttggaactattctgcccatagtagtccctagccacatgtggctcttgtcaatgtaaactgtgactagtccaaactgagatgtgctataagtgtaaaatacacacaagatttcatagcattaaaaaaaaagaaatctcatttaaaatttcttattgatttgcatgttgaaataataggatacagtgggttaaataaaatgtaaaattaatttctcctgcttctgtaatatggcaactcaaaaatctcatgtgccttgcattatatttattttaacagtactggattaaaacaatgccaaagcagttgtgaagtgaaaacaaaatgagttgagctaaagtaaatattagtaaagttagcataaaggtattacaaatatcttgaaatttcaaagctaataacctatgtttggtaacactatacaacatccctggaaaatggaatccagcttttgaatattttctggaaagggtatcttagtacttccgaggttgttcaatgtagtggtagagggggtcaaatgaaaaacatttcttctttgtattgactggaaatctgaaaaacctttgtacatttctctccaatgcccttagttctggcttataaagcacagcacaaacctacccactactatccataactagctggttctggccttttgaacctttagtttcaaggctcccatgaaaccaacacagcagctttgtaacttcacaaacttgaaagaccacattgttggaggaagattcttactgcaggccctggcattccccattgatgagctgaaatcagttattatgaggttctgtatacaccttctgatgatggataaaacaaatgcatatgcctcacaggcacagcaggaattaaaaatacattagttcatcgcaacttcagatctgggattgaggaacgtttggatgacttttttttcttttcaaataaagtttagatgaggcaggaatttcactacagagtagagttctgagactctccaggtccagttcagcacttggagagaaatcaaatacatcttatcttaggtatggcactaactttcatcaaaaaattatcatatgctcagtcacaaatggttattgtaaaatctttactaacctaagtgcatataaaaattgtgaattcctaatacaaagcagtatttgacttttaaatttcattttaagcttggcccgttcacttggaatgtgattacagagtaaattaaaaagtaatcacatgtgaattacatttcctcatgaatgtaatgacttcaggaggctgattaatgttaagcagtgcctgtcctactgcatgcataccttcccaggtgagatatgcaagatagctgtcgtgagttgtttaattttcttttactggtattccagggagactgcctgaacacataataggctcagcacattcattaggactgaggatgttcttccctttggtatgctcaagtcccacgtgcaaaataccatcaccgtcaacttatggttatgagaaaagcccaagggaggcggtgcagctctggtaccattttctacctagccaagtttcaatttctcaatctctctttctatctttttggcaaattcttcatatttgaatggaataattccagagaatcactgaaaaatgcatttgcaccagtgtaaaggtaacgaattgtctcacaaggaatgaaggcttattaataatctacaacagtattactgcagagaacaaaatttaaactaagtggagcacaggatcattaacatatttcctctcaggtaatggggaatgtagcagtctaaaatatttactcctttctgtagtcaggttaaggcattgttttctaaaggagttgtcagaggaatcacgctattgttagaagtggaaaaggcttggtgcttcattatttctgtgcaaaagaagagcaaatacagtggatttagtagccagccaaggaaagccaggtactaaaaattaccttgggacaaaagttggtcttttattcctgtgattccccattccactgggaggaacaatgaactagtagagcagcctgagaacatgttacatcataatctagaacatatagacagctgatgtcatgaaactgtcatactatatgtgatgctctctgacatcatctattatataaaattttgtttttcttttttaagtttggtgagacaggctaaattgaattcaaaatccatcagtgactcatgaccatcagttagaaacattctggattgggagcctttggaatcacaggagttgagagactgccagctcacttcattgtcatttaactgtgggtcctcaaaggggaatgttccaaatgtcatgtcttcccagctttgtgtgggtggtgggaaaatgaagaggggtaatagcgagagaattaatgtcaggagaataagacagaaaaggcctacaattctgtagtttctcctaagactggcttcaggattcctttgagtttaatatttctgttatgtttttatcctgagatatttaaatttccagaacattcaaggtcaatgataagactattagaaagatttttatttaaacataaactcaaaagcactcaaggataaagaagaaacctatgagaactctgagtaggtaacctacaattcttctgtgttaaggagagagtagagagaattactcttgtgtttcaaactgggggtgtcaaacataggggactaaaaatgtgaaatataccagtatacaatataactccattgccttaactgagatgacagacactaatattcttttgttgtactagggtttttattctgcatttgttgtaccttataacatttttaaggcctttactaacccactgtgtgattcagaagagggtgatcaagaaagtgagtgacctagagaacacaccacgggataaccaatcaacatagacaaggtaagacttggacactagggatgggattaggaacagggtgtctccatccagaggacagtactgggtccaggctataaaggcagagacactggattgtgggtgctccctgacgtgctaatgagagttctgttaccaacaggactgggataatcaatttcccttctctgcatcccctttccacattttagggcctgatgtttgacagccatctaatgagctaaatgaattctacgaattctgctctaccatgttggatttgctcttgtggataatactcagcagaccactacaatttctagtgggtcacaatctacttttgacctcccccttctctaggacatatccctggcattttcctatacatgaccaaaattacttttagagaatgtaattttgtataaaatgggaaaaattaattaaatcattaaaatatgaaaaggatcctcttctaacaaggtctttcctctacagggcatccatgctttgaactctagggacagcattaaactgaagcaccagtgtctttcttctggaatcagaatccctttgttgcttttgggggaaaaaaaaaaaaggctgtcattgaacttttaattaggttccaaaaatgtgacctgaggcaataatagaatgatttattttaatgctacactgctcttgatgatattcggttaaaaatgggccagcctttgaaacaccctgacaccacacactggcatctacaatgttgaggctactgattcagttttatttcccaagatgtctttctttactcctttgttcaaccacccatccttctgtccattcatccattcaacaaacatcaacatttattgccaggcattaaggacagacaagcaacaaaaataaaatggtccctgtctccaacagaacttactaaagttcagctgggaagacaaccacttacccaacttaaaatagaacaacgtgggtggaaagtactcagtccaatttaaagagaccataatatctaagttttggtctttactgctccctctagcctgggttttatgtttggtttagccatttaaccaccactatgtataacaacacgtatgttccactgctgattttaccaacagaggccagtctcacggtgggaaacgtggctcccaatggtatcttatataccaaatgatcgtctatggtagatttcaatcatcattctaaattctacattgtgggtttgtatttctgagtgccaatacaaaccacaatactatctattttttaagagatggggtctcactatactgcccaggctggccttgaactcctaggctcaagtgatcctcccacttcagcctcccaagtagaatatcttaaagtccagggccattcagaggaagagagatgctacactgggtagataatcagaagaaaagaatcatttaacaaccaccctaccccccaaaaaaccctttctctctgcaaaatggaagggccatctagaaagaaacagaatcattcatacatatttattttaaaaccaataattaaccacctattgcagtactgaagttcatggcctacatgggatttattatactgattagtccacttctgtgtatatttaacctatctcataactttttttaaacagtcaatactaataaatagctgagttcatctaaaatatattggatctaagactacccaaattttcctcaaacatcctaactagaccccagttaaacttcttttggagtctcagggagaaaaaaaaaaaaatagaatgctttagaaattcttgattgaattttgttacattagctcagcataagcattacagccaccaaaaccactcttaccagtaagttctccatagcaagagatggctgcctgtcccaggattgcccacatatgtcttcttaggatactccaggaacaaagaggagaaaaataatcttggaaattctgtagactgttttgactttttaacccattcattcaatccataaaaatgaacaaagtgctataatgttacagtggaaagagcatcttttcagaggaagatagctggaattttagtcaagacttcgtcactaattatcattgtgcctttaaagcatatcacttcacttttctggaccacatttacttacaagaaaaatgaggaagttggaccaatgacctagtagcactcgtttctgattctcagtctgaagtcaatggatgctattaacatggaagtattttgaagctgcatttcctgcaggggcaaagcaatgcttcctccacattttcctgactcctttcaagttctcctagagagctcctaagacaattcataaagagaaagggggtactgctgcccaagcacacatcctttgtcacggtgtgtggtcaggcactagttggcattaatttacttgttcacagttgtacatgagacattattggtagagtagttatggttgcctgattgtggatgtgtaactaattctggaaaaggatgctataaagttacaatccaaacaatctcagcaggtgtcactgtagtcaggagaacatatcttcacaaatactcattatttatttatccttaagtaagagaaggtccctaccagccagcctaaaagtactgagctctgtttcccatcataaggccaagaatcatcaactttgtaagatcaaaagggggttttatgtatgctctgtcttcgtgcaggtctaagtggagccatgacaacctgaggcacatttgtagatattttttcaaggttataggcagaatggcactccatagcatcagtcagaaagctactcccatgccctactttgtctatgacctcagctttatctacttttatttatgagtgtggagcttaggatttcagtgacagaataatttgtttgacacattacagttaaaaaaaaaaccccaatagaagtacatagacatacacacacacgtgtctgtaaaattggtaaaatctgactaaactctgtggattgtaccaatgttaattttctagttcttacatgagactatagttactacagttaagcaagatgctaactatagagagtttgcatgaagtgtgtgtgagtctttgcatttttgcaactcctgtgaatgttgaattatttcaaaacacaaagttaaaaaaaaatgacaaccaccaaataattaagaaacctataccttcaaaagcaagatttaaaaagtaattgtaaaagttcaggaatagtgtaatgacacggttcatcatcagtgaacacctctccttcaaaaaatatttgtatgataataaatatccctcaacaaaggcatgtaagtcaccagtattcattcccaggaaataaggactgtctctttcaaaaatatttagaggacctgagatgacccttttcccctaggtcacaccaagagtttttatcactgaaagctcctttttgcaattcatagttttgacaaaaaagattttagtgatgtgtctgtgtctccagatgcactgctctgtgcaactatataataactattacctggtcaacctatgtcagcccattggaactgatctttaagaacacaaaaacatatatgtacacactggtatgaacagcaaatcattcttaaaatatttgatttagaaaaaaatgcaagagagatgatagttaatatccacaaaaggcaacacaatttcacaaatagacaagaaggggacaaagaaaaactaaaagaaaaaaatgggggcaaagacaggaacaggaagacaaacttcgcatgttctcacttattagtgggagctaaaaatcagaacaattgaacttgtgaagacagagtagaaggatggttaacagaggctgggaagggtcatggggaggggggtgaatagttagtgagtataaaaaatagaaagaatgaagaataagagctagtgtttgatagcacaacaaggtgattatagtaaataatttaattgtacattttaaaataaaagagtataattggattgcttctaacacaaaggaaaaatgcttagggagatggatactgcatttacattggtgggattattactcattgcatgcctgtatcaaaatagctcatgtactccattaatatatatacctactatgtacccgtgaaaatgagaaattaaaaaatgggcaaatatatggagaggtattttatttattttattattttatttgagacaaggtctcagtctgtcacccaggctggagtacagtagcgtgatntcagctcacctcagcctccaccccctgggctcaagcgatcctcccacctcagccttctgagtagctgggattacaagcacgcatcaccatgcccagctaatattctggtttttttttttttgttttgtttttttagtagagatggagtttcaccatgttgcccggactggtcttgaactcccgggctcaagcaatcttcctgcctcggcctcccaaagtgctgggattacaggggtgagccacccttcccagcctgaaaaggtatttttaaggtgggacaatataaaaagccaataaaaatgaaaagatgctcaaatttaatagaagtcagaaaatgttagagaaaacaatgagatgtcatttagacctaatgcactaatacaaatgaaaataaggggaaatacctgctctggatttagataaatggatattctgatacatggtagattaaaatatcacttttaaggctttatgaaatgtaatgtaacaatacctatcaatatttaaaaagtacattttcttaaatctagtactttcatggctgacaatctatcccattaaaagtaggttattagtgagaccccatttctaccaaaaaaaacaaaaaaatctggccaggcatggtggcatgcaccagtagtgtcagctactcaggaggctgaggtgggaagatagcttgagcctgggaggcagaggttacagcgagccaatatcgcgccactgctctccagcttgggtgacaatgagaccctgcctcaaaaaaaaaaaaaaaattatatgagctttttgtacagtgataagacaaaacaaaaccacacaaaggctggatcccaccagcagaaaatgttttaaaattatgttaccgccactggacataatgaattagatttatacagtagccttgaagggatttcctcaaagaattattgaaagataaaagaatgagtaatattccatttttgtaaaacaatgactgaaaaatctctccagatatgtatatataaatacacgtatgtattaacatattagcaggttgacaaatacacaagtataatcataggtcagaacgtcccaaattctgcatcttggcacaagtataagataataacttttatctaacactggggtggaaagataaaggttgttcatcaccagaaatgatgagccaaaggatagagccacctaaaaagcagtatttgagcaaaggagttggggagttcaaaaggaagttgttgcctgaggaggattctgggagcactccaggaagagggaggatagagcatggtggatgaggtgggtcatgtgtacgggaatgggatagtaccgagtgaaaacatgggaacaaaatgacgcaaagttcagaaatacacatacatacatttacatatatgaatacgtatgtgtattcttgaatttcatggtcatatttatgcattttcggtgaaattgtgtttttaaaacttactttatgtcttaaaaataacacttaaggctgggcgcggtggctcacgcctgtaatcccagcattttgggaggccgaggggggcagatcatgaggtcaggtgattgagaccatcctggctaacacggtgaaaccccgtctctactaaaaatacaaaaataaaaaaaaataaaaaaataaaaaaattagccgggcgtggttgcaggcacctatagtcccagctactgggaaggctgaggcaggagaatggcgtgaacccgggaggcggagcttgcagtgagccgagattgagccactgcactccagcctgggcgacacagcgagactccgtctcaaaaaaaaaaaaaaataaataataataataataataataattataacacttaaaaatgagcccaggtagatgatcttccagtaatttctcccttgattttcttgttcttgctgctattaaaatcaagagggcaccatatttctccctttgctcttctaagatccagtacttatgataagaaaaccatagtccaacacaccctatgtaagttattctgtgtatctgagcttcagatgtaaaggagctctttcagacttcagggttatgagagtttctgaatagccacctggcaaatctgggtagatgttgactttcccagcaggccacgatttattgccaaaagcacaatttttttcttttgttttgacttaacatgccagaaaaaaaacacaagactataagaattaaacctaatgcatcacagctaagctctctaaggcatgaaagaggcaagggctgcaccaaaacgaatttatcaatcacggaatgcaggaccccttgtatgattagcttaattatttaaagaatgcaaaagaggtggacggttctaccattaaattatcctgtttaaagaaaatgccaactcggtaagcatttctaagtggacaggctatttcaatagagtacattgctgaatgtgtgtgtgtgtaataataaaagaggctgccctttaaaaatccccacaccacgtacttttattaatttaatttggtgtccactgtactttttagttcgctccagttgcaattactattctagtttaatttcacatatatttgcattgtttcatggaaacccttacctcggtaaagagtaaaaatagatacctcccactagacccacctcaaaaggatatatgtgtgtgaaaacatacatacacaactaagtgggatgaaagtgatctttagagatatgggataaaggaaaaaccatttgaaaaaagtctcagaacactcctaggaagaccatatgtacttcctcatccagcaaagtgctatttcaaatgtgttaaataagtagggagtgtgtcagtgtgcgtgtgtgtgtgtgtgtctctgtaccaataaacatccagaaaaaaagaggggaaaaagtcaatataaaaatttagaaattagaatatttacttttagttaagaaaatttctagaaagttttattttgatatacaaaatataagacagccatctcaacaatcgtgtccagtcattcagcaatcagccaccactgacaacctacacctttccttcctttcaataatggccttccaacagacctcgaaaggcttctatatgggtcacttttcttactatatctgtattttttttccaaacctaatcctgtttgttctgaattatactgagtttctgataaactttaaaatgtttttcttagatccagctgcactaagagtataaagcgaatttagaatcaccaccccacagtccccccgccgacaaatcatactatttaatatggcggtgatgagaacaacgtatgtgactaccgtgacactcaataaaaatgctatgatttgctttttaaaaagtcagaaacctatagaattcgtatgtgagttccactcattgtttctataaaaaggtcattctgatatgttttagggcattgtcatgagaatgtgtgaaaaatctataggcttacaaaacatgaaaactcaagatactggttggtaaggacatggtaggggtaatgtattcttagaagagaggctgcatcatttctgcagataaatttgaaattttcttcatgcaatttggaatgtaatctcttactagattaaattttacagctcaggaaggtgaggagctggtaagagcaaactgcatgagacaagagtatagatatccaacaaacaatgaggcaaccaacctgattcacttagtacttgacagcaatgcttttattagaaacactttacttatgacctattaccagtggttcctctactattgggatacatttaaatctgtcattttaaatgtgtttacactttttctgtgtacaagaactgctgacaaaggcaagcgtgatatgtcatactgatgacgtgttaagctgaggaaatttccactgccacaggcaacactttaaccttatgaaacattttaatcacatttttattgaagaagcttattaaaagatgcaggctttcagaactcgacaaattttcttgatcctttgccaaatcagaggtaggcaaagtgtactctgaaatcacctccccccaaattgtaaattcattttctgaaattagatattgacatttaagcatcatataaaagtcaaacttttctaggatggctgagaagttgaaaatcctaaatgcccacattatgagaaaagaagttaaggcaaaggccaatatggtgagtaattttaaatttacacttagcatttagccccttttctgcattagtcccatgttaggaaccaactcattctttcatatccaacatatgtattttcagtatttgctaagaaataatcctcatttcaaagcattggttattattttctacaaaagcttggtttctcaatagtataattctgtgtttgcagactataaaagtatagctctgagaatatgaaagaaaataatcaccaggacaggcaatcgatttctgtgtgggcaaaaattttagaccttttttgtaggtgaatgacatcagagagccatttagctctaagtttccatgactacctgtaaaatggagatatcattcattcactcattcatttgataaatatcaagagaacatccacaatatttcaggtacagaactaggtggcattggggtgacagagaacacactggttttgcctttaaggacatttatagtctacttgctttctgtccacttcgactcagacataaagaatatttatcaaatataccggaagtcccagaataagggtactctaaatacatcattcaaatttcaaaatagaacctaaaaaacaaatgccaaaacatttacccaatgtattcaggccttatgaacctagtgattaacatatttttaatatgttatttcagctatactgtaactatatggtgaaacacaacaaaccaaactacttggtttatttagtttagtataaagccacatttagtagtattccaactcagtgctcttcggcaagtatgtgcacagctatattacgtctaggcactgtaacagtggctagggagatgatgacatgatgacatgatgatctgttagaaccctgtgaccttaagaagcttatggtccagaaagacatacaaatgtgtcattcactatgtgatactcctctcaatctcttcctctcaccatctcaccatctttcttacattcctactcctgatttggtccagacaatccacccatcttccagagccaagaactctgttgagccaatagtaaaaatctcattccctctgcaaaggatttgtttgtttaggaaagttgtgtgacccagtttcagccaacaaggaaagtgagtgaaaaaccattcaatagggcttttgaaaaagacatggaaccaatctaaatgcccatcaatgatgaactggatcaagaaaatgtggtacatatacaccatggaatagtacacagccataaaaaggaatgagatcatgtcatttgcagggacatggatgaagctggaagccatcatcctcagcaaactaacacaggaacagaacaccaaataccgcatgttctcactcataagggggagttgaacaatgagaacacaaggacacagggaggggaacaacacacaacagggcctgttgggggtggagggtgtgtggggagggaacctagaggatgggtcaataggtgcagcaaaccaccatggcacacgtatacctatgtaacaaacctgcacgttctgcgcatgtatcccagaacttaaaataaaaaattaagtatcaatccaaaaaacacaaaaacaaaaaccaaaaaaaagtttcttcactctttccaaaaagaggtaaaagataaacccaagtgaatggagaatttggtatatgataaatatgctatccttaaatcactggggagaagatggagttttgatatgaactgttgggataagtggatagtcacatgaagaaaggtaaaatcagatccattccttagactttaaaccaggataaattccaaatggatcaactatttaactatgaaaactaaaattaaggactagaaaaaaacatggtaatatgtcatctcaataacctaggaatggggaaaacttttctaacaattatttaaaatcccaaagtaataaggaaaaacatggataccagtgattacataaaagattccagaaacaaattgggagaacacattggtaagcttcactagagataaaaatccccaatatacaccagggctgcaaaatcaggaaaaaaacagcccaaaatcacactgaaaaatgagtgagaaatatgaactgattagctcataaataaatgcaaatgggccttaaacataagaaaatacactggactgtgctgttaatatgacaaatgcaatcgaaaacaatactaatataacattcctcacctatctgacaggaaagtcttaaagttcaacaatatagtatgttggccagacttagggaactaggaattcttatatagttgtggtataaatacaaagagacatatgcaaaccctatggataagtgttcatcaatacctagcaaaattacatatgtatttatcctttgacacagaattgcacttctgggagtctatccaaaagacacactagcaaagataaaatatatgtttgcacaaagcaattcactgcagcattatttaaaataacaagagattgaaaataaaaatgtttataaataggggatggagtgagaaaaaaacatggtacatcccccatgatggagtactataaaaccgtaaaaaaaaaaaaaaaaaaagaagaggaggaagaggaaaaagaagaaaagaaatcattctagaaagtgcaactaaatgctctccaggctatttttctaaagaacgaaagaaagttgaagaaaaatgtatagagtatatataacttttcaaagaaaggatggaacacaaatataaatgtatttatatacatacatgtatgtatatccacatacaaacacatatatgcaaccttatgtatatattgtatttgtatttaataaacagagtaagtattaaaaatttgggggaggaagaaacagagtataagggagatatagaagttatactactttgaacatactggttttatagattgattctgaaatcataaatattctacataattataatgcaaaattaaatctaaaaaagcaatctctataaattgaaagtaaaataaacctaatttcatatccagttgctatcataagcactcacagaggtgctatttctagcgattttatttaagatacataacaatttaaaggaaaactctaaactgctcatggtaattaaattatttgtagtaggactggtatcgatattctgagactcttgtgcatgtactgtgaataaatcaaagaattatgatggtatcattaagtgctgaggttttgttggggaaggagagtatggttgaaatgaaataaggatgtgagatcaatggggtaaggcattctgactggggaaaaccactctcccaaagatgagcctacaagttgccttagctggttctccaggcttctgtttctaaagttattgtcatgacatctttttaatgttcgcttttcatatgatgaggccaatatatacatattaaagtacatttacatgcatatacacacgtaaacttatttggatagcatgttctcatgcatcgatcacatttctgatttgagataatagtacactaggttaaattcttcctaattgactgtggccaagtctgctcacgcccagcatcggacctcacattctttcctacctacttgttttaagctgctggctccttgcagtcacttggcagaaaacacttctcctcaaacttgcattgtatttctagctttcactcatcaatatgaattttaaggctcccagtgaaaaccaatttaaggtatggagcctgtttaaaacaaggactggctccagtcacacccttattttcagaaaataagcctctgaggcactcccaacatagggacatgcagccaggacgccaagtggtatgctttggtagaaagaattaaaaacaacttagtataaaaacgttagggtatttgttggatttaaaaagtttagctaatgtacatgacagcagacctcaaagcaccagaagactcccttgtctgtaatagagcttcagatagaacacacctcttgaaataatactaatatctattttgggataatataaggtattttctccaaaacacatatctctttcacataacgggagacatataagtaaacagaaatatctctgaagacaactaagtgttgtttaagcactaaaataacaatctaatgaattagtaagataagaaaaaatctatggggagaggaatattatttagtttgggaaaataaatatggtttgcaaggcatatgaaatatcactgggacagaggacaggaaataatactgggcctgggacaggatatgagaaaaacaagatgaaatggaagatgtgagaattcagaatagacaaagaaaaaggacatggcggagcaatcctgggcgctaatgattttctaagaaaccagcaaatccgggtttgttcctgaggatgttccaagtggagcagctgtctatctcagggattttgctaactccagaagccatcagcctagtgcccagtgaatgtttaatactgagatgctttcatgccacctgaaagaaaagcaagagagggatctgtgtccctctcaaagtacctagtactttatggtagcttcattggtttattgcgttgattattcaagattccttggctgacgatgacaagaacacaaatcaaactagcctcaactagaaagagaattaattggcttatataactaggtattccaatgatagagagaacatgagacaaatctggatcaaggcacataccctttcttgctctctctccccccatctgcttctttccgtctcccaattctgtttgtctctgatcagcttttggcctcatattcttcttccatgagcagactctgaaatcccaaacccacagcttttttgtgtcaagtcgtctctctacatagatcagatttcaccgaagcaatcttactgacagctacatgggagatgcttcagcttcctggaacaatcgctggggcatattcctgtgattcagacattggacagacccaagtcaagctcccacaggccactacactggccatttccaccacaaccatacaggatggggaaggagcagttttccaatgaatcccaacaacagatttttcccactatccttccaataagactatttttcctccaagggcatggcctctcaaatatttttggccttctccacactttaccataacatctcctaaatatatgccccataattaaacagatggaaaccagaatttttattgtagacatcatcagtgaattattttcacagattgcaaatacattccttcaatattccattacctgattgtgatcacctaattagcagatgaaaactattcagagtatcaggagcataagaggaacaaggacatgtcaatttgaaaatgatatccttagaaagcatgcctatctacatctcctatctctaagtcataaatggaaagcatttaacatacttactgaagatttttatatgtgaaaaatgggatggttcaggtagcctacagatcctgcaaccgtggtgtgtggaacataggtgtcatgcagaataatctcatgtaataagaggttcagagggtggtcgtgactagcgcaatgggaagctaagtagatacgattccaggccctaccctcactacaaacagaaggtccaagatttcatcctctttcttatttgagagtttcatatttttcatttttttgaaaaagcaattgtactgccaaactaaaaaacttacaaacaagcaacaaattgtattagtctaatcacctcattatactaaagatgaaatagtttctaaatacagatcctaaacttgctgtcatttaaatttcaacacagctatccttttacttcaccaggctgcctttcttaatttgattttacaaaggaaagctttttaaaaaaaactaaaactaaaaaagcatagtattctatgcttgagttcttagactacacataaatatttaggccgtgcttatcagaattttagaattctgaagagcctccctgaactgtcaaaacctctaaaagccacaccatgctggtgaggcgacagagtaaagggaacacttacatactgctggtaggaatgtaaattagttcactcactgtggaaagcagtgtggaaatttctcaaagatcttaataacagaattaccatttaaaccagcaatcccactactgggtatataaccaaaggaaaataaatctttctgccaaaaagacatgtacactcctatgttcattgcagtactattcacaatagcaaagacacggaatcaaccaagatgcccatcaacagtgaactggataaagaaaatgtggtacatatataccacagaatactatgcagctgtaaaaaaaagaatgaaattatgtcctttgcagcaacgtggatgcagctggaggccattatcctaagcaaactaacacaggaacaggaaaccaaatacaacaccctctcacttataagtgggagctaaacattgaatacatatagacacaaagatgggaacaagagacactgaggactgcttgaggagggagatgaggaggggcacatggattcaaagcctgccaatcatgtacgatactcactacctgggtgacaggatcattcatccaccaagcttcagcgacactcagtttacccgtgtaacaagcctggatgcacacccctggaatctaaaataaaataagataaaagtaattcattcaattaaaaaaaataggctgggcctggtggctcacagctgtaatcccagcacgttgggaggccaaggcaagtggatcatgaggtcaggacttcgagaccagcctggccaatatggtgaaactaaaaatacaaaaactagctaggcatggtggtgcacacctgtaatcccagctactagggaggctgaggcaggagaatcacttgaacctgagaggcagaggtcacagtgagcagagatcacgcctgtaatcccagctactagggaggctaaggcaggagaatcacttgaacctgggaggcggagtttgcagtgagccaagatcgcgccactgcagtccagcctgggtgacagagtggtactccatctcaaaaaataaaataaaataaaataaaatggcacagaagcatcaaatgtggatagaagaaatatctacctatgcctctgttgaaatatcaatgagtctgtctaataaatgcctgcaataggctacttaattaaaatgaatagctttagcaatcaccttggttgacaacattcagaatgaagagcaaataatagttaacacttattctacataattactcttcccttccgtacacaaaacatgtacagagcctgggcttggtaacacgaaatttccaataatctatgagagaacacttaaagactttacacttaagaagaataatttttggattaattttgaatctattttccaaaagtaaatgactttttaaaggcctagtcagttaccatgataaataaagacatacactccaagtatttggcacatgtaattacagtaaaatgaacacaccccatatcaagcacatctttgtaggtcaagatggcaataagaaagtatttttcactctggtccacagtgatcaaagggggatcaacactgaaactgtatttcagaatgccagccaaaagctttgaccatgaaagagaagcagtgctggccagttgcccacaagactgcatactacattaggttttaatacatttcaaaaacagagaatttatatagaaactgtgacaatttgaagaagtttgctgggataatcttagaagactgatctaaagacagtctaggacagctgcatgcaattctaagagtcagatctgtttgtttgtttccgagataagcgtcaaatactaatacagataagagctaaaactaaaataccaattcagtgaaaaagctaaaacccagaagacgttttatttcattacctgtctgaagttatttttaacagtgacaggtcatgttctatttcttcactggggtaagagagaatatttgaatgtcccaaatatattaaagttataggcaaaaatgctcacaaaccatttagaaaatgattcattttactgtctacctaatactgagctgaaatactctactctaagctgactgcttagagtatgtttactatctgctaatcctatagctcgcacttaaacaaggctggttggatagataatccagacaaatgcagggttccataacagagcatttttaaatgtcttaggctatcacctaagccacaaacaaaattgatttttccagacatgttccagtgtctgcttaccctttcctgctaccaactgtcatctcactcccctgataaaactcttgacatgttttgcagtatcctctactcccttcccattccaaacagctgtcttcccttcctggcagaaactccctgacatctggatactcaggatggctactgttatgatggacagattccattttatccaactacccagctccgagaatataaaaatgagcaaaaggaggagaagtgtgatagtttcaccagctacacaaatactagttcaagtaatggctatattaaagcattagcatgttgaataattttcttttaaaagtccaattttgtgacatctgtaaaatgatacagaatgttaaaatgcgatgattctgaaagaatacacaattacaagcttcctaaatttctactcaggtaatgacaacaaatccaagcccatagctcaaacataggatttctgcttcatggcctaatttgatgtttttttactagatttaagaacaaaaacatgtgtgttagatgaagacagatgagtcgaagaaaagacaaaacatgagtcactttccttgagctcatcgcccatatcccatcaatcaccagttccactttgtgctgcttcctaaatatgtatcatctcttgcatattctgctacactggtttcttaaactgttttcctatatccattctcccactacttcagtctattctccataagcagccagtgatattttattgaagtgcaaattgggtcatatcaccctaacaccccctttctaaatccaatcagtggtcccccttccttgtagaataaaacctacgctagtccacatggaccctaaagctttgcataactctggtcccagcttctctctggcttcatcaggagcctgtcttcccctcactcaacatattcaaaccacactggccttccctccattatccaaatgcatcaaatttctcccattcctaaggtctgctttagcacttttctctttgcctggctccctcctgcccatggttcagatctcaatttatatgtcacttcctcaaggaattactctgcaatcaactgcaatatgttatgtatccttttatatctctcatgggatcatggaatttttcttagcagcacttttaacaactgtatttaattaacatattaagtcagacattaaagagatttgcaaaactataaagcaatgccattctcaatttttggttttgaaaaattgttaattcttgtttaaaaatgttatcttaatgtgcaaaatgtttattattgttttaaagtattattttaaaaaaattttaatttctaatatggcaaatatcaatagatttaacaacataaacaaaacttctttcggtcgtcaatcttttttaggagtataaagggattctgagatcgaaaagtttaagaaccactgaataagaaattaaactatggcttgtgaaagaatgagatactacattttaaatcctttaggaatacttaaaattgtagttaaatatattttatgtaggaaacaaagctttcaagtaatgttgctaccttagaaagaaaatgcttaattcttatatactgctaagagaattataacaggattgtacagctaggtcataagcaatgtgtcaattataaaacagttgataagaaagttcaacttgccatgacaaacatagtttacagctttaaatgaacaattttttctttgaaagcattctaacaaatgttatctttaataacaaacacatatggcctttaaactttcaaggcaaagattcttgaaaatcataattaaaacaaacctttcgatcttacagaaaagttcttaacagaagactaacaattttgcaatgacaagatggtgaatatgtgctcaatactaattacagtcatgatgactgtgatatcaacaaacccatatatggtacttttctaagagcttagaaatcagccttagttactattattattagcccaaggatatgtaacttaccctgcatctgacagctaagtaagtgacataaatgaggtttgaatccagggtctgagctcttaactctatactgcctacatacatacatacatacatacatatatacatacatatataaattaacctttcttatcctgcttctaaacaaaggtaagggccacccagtcaatgctttgtattcttccaatattctttcctagaacttcttcaaaggctctcatgaagcactggtgaaactggaaatcactgaattttactaccattttaaccaaggctgaatcaaataatttagaagttaatattgtttatttacccagggtctatctacccacattactctcattttgttcacaaattatctaatttcctactgcatctggctttgcttattttgggttttcattgctcctgaagatttttctggcaaattctgggtttctgcccctcgtaatccttctgtggacattcaacatgaaatactaacgttcctaggccactggactcttggaaagctaatgctgtgaaatctttgctttgtaatagccctatactttgttcaatatctatttcatctgtgtaacaagtattataaataataaaagttgggagtctccagtaactgagaaaattctacccaaagtcaacatatttatgttaaacaaaaggtagtttgtattctcaaaatgaattgagttattgggtctgacatcctcctgattaaaatgtaaacttattattgagtaacgaactttgaacatagtcagaattttagagaaacatcaatttaaaatatataattaaacagacagagggctgtaagttcatctgacagaatatgtttacttttgttgaaatgttaatgatgtcagtgatacttccctgtcccccttcattaatcttgggaaaataaactatctgtttctcctcaaagctttgttctcctcactccatttcttcttgtcctcacccagaagctaatgaagtaaaagctttagggcttcttaggctaacaccccttctaagatcttgtatctaaatgtgtggttataattgtgtaggctttatcctaaagaggataaaaattgcataagattcagacgctactcaacctggatctgccttacgtgagttgtaaatatttcagtcaacttgcaattactgctcatatttttgtttctctgtacttgcagccgaggaaaatcctttggagtggctcatggacatcagtccccctgatacaaaagcttattttggcaagaaagtggcaaagaattacaagtcaggatagaggctaaacatgaattttagatctaaatttctatcaataggtaattagatgaaaaacaataataaggtagatccatatcagagacaaagtggaggcctctagtcctaaatgggcctgaataatttagaaatgtaacttaaaaatgtttggttttgggaacattttatgtaaaaattcaggtgtcaaaaatcagacctgataaaactggg
